(12) United States Patent
Terman

(10) Patent No.: US 7,803,637 B2
(45) Date of Patent: Sep. 28, 2010

(54) COMPOSITIONS AND METHODS FOR TREATMENT OF NEOPLASTIC DISEASE

(75) Inventor: David S Terman, Pebble Beach, CA (US)

(73) Assignee: Jenomic, Carmel, CA (US)

( * ) Notice: Subject to any disclaimer, the term of this patent is extended or adjusted under 35 U.S.C. 154(b) by 204 days.

(21) Appl. No.: 12/145,949

(22) Filed: Jun. 25, 2008

(65) Prior Publication Data

US 2009/0155231 A1     Jun. 18, 2009

Related U.S. Application Data

(60) Division of application No. 10/937,758, filed on Sep. 8, 2004, now abandoned, which is a continuation of application No. 09/650,884, filed on Aug. 30, 2000, now abandoned.

(60) Provisional application No. 60/151,470, filed on Aug. 30, 1999.

(51) Int. Cl.
*G01N 33/55*     (2006.01)
*A61K 51/00*     (2006.01)

(52) U.S. Cl. ..................... 436/520; 424/1.17

(58) Field of Classification Search .................. None
See application file for complete search history.

(56) References Cited

OTHER PUBLICATIONS

Fabry et al (Proc. Nat. Aced, Sci.USA 86: 3808-3812, 1989).*

\* cited by examiner

*Primary Examiner*—Richard Schnizer

(57) ABSTRACT

The present invention comprises the use of sickle cells or sickle cell precursors loaded with a therapeutic agent that localizes in tumors and induces a tumoricidal response.

2 Claims, No Drawings

COMPOSITIONS AND METHODS FOR TREATMENT OF NEOPLASTIC DISEASE

CROSS REFERENCE TO RELATED APPLICATIONS

The instant application is a divisional of U.S. application Ser. No. 10/937,758 filed on Sep. 8, 2004 now abandoned which is a continuation of U.S. application Ser. No. 09/650,884 filed on Aug. 30, 2000 now abandoned which claims priority to provisional application 60/151,470 filed on Aug. 30, 1999. All of the above referenced applications are incorporated in their entirety by reference.

BACKGROUND OF THE INVENTION

1. Field of the Invention

The invention relates generally to therapeutic compositions and methods for treating tumors and cancer.

2. Description of the Background Art

Therapy of the neoplastic diseases has largely involved the use of chemotherapeutic agents, radiation, and surgery. However, results with these measures, while beneficial in some tumors, has had only marginal effects in many patients and little or no effect in many others, while demonstrating unacceptable toxicity. Hence, there has been a quest for newer modalities to treat neoplastic diseases.

Erythrocytes from patients with sickle cell anemia contain a high percentage of SS hemoglobin which under conditions of deoxygenation aggregate followed by the growth and alignment of fibers transforming the cell into a classic sickle shape. Retardation of the transit time of sickled erythrocytes results in vaso-occlusion. SS red blood cells have an adherent surface and attach more readily than normal cells to monolayers of cultured tumor endothelial cells. Reticulocytes from patients with SS disease have on their surface the integrin complex $\alpha_4\beta_1$ which binds to both fibronectin and VCAM-1, a molecule expressed on the surface of tumor endothelial cells particularly after activation by inflammatory cytokines such as TNF, interleukins and lipid-mediated agonists (prostacyclins). Activated tumor endothelial cells are typically procoagulant. Similar molecules are upregulated on the neovasculature of tumors. In addition, upregulation of the adhesive and hemostatic properties of tumor endothelial cells are induced by viruses, such as herpes virus and Sendai virus. Sickled erythrocytes lack structural malleability and aggregate in the small tortuous microvasculature and sinusoids of tumors. In addition, the relative hypoxemia of the interior of tumors induces aggregation of sickled erythrocytes in tumor microvasculature. Hence, sickled erythrocytes with their proclivity to aggregate and bind to the tumor endothelium are ideal carriers of therapeutic genes to tumor cells.

SUMMARY OF INVENTION

The invention provides method of treating tumors using sickled erythrocytes and their nucleated precursors as carriers of therapeutic agents selectively into tumors where they induce a tumoricidal response.

DESCRIPTION OF THE PREFERRED EMBODIMENTS

Provided also are compositions and methods for delivery of therapeutic nucleic acid constructs to tumor sites in vivo using therapeutic genes carried by erythrocytes from patients with sickle cell anemia which have the unique capability of adhering to sites on tumor neovasculature.

1. Cancer

This invention is used to treat any type of cancer in a host at any stage of the disease. More particularly, the cancer is a solid tumor such as a carcinoma, melanoma, or sarcoma. This invention is used to treat cancers of hemopoietic origin such as leukemia or lymphoma, that involve solid tumors. A host is any animal that develops cancer and has an immune system such as mammals. Thus, humans are considered hosts within the scope of the invention.

2. Nucleic Acid

The term nucleic acid as used herein encompasses both RNA and DNA, including cDNA, genomic DNA, and synthetic (e.g., chemically synthesized) DNA. The nucleic acid can be double-stranded or single-stranded. Where single-stranded, the nucleic acid can be the sense strand or the antisense strand.

The term isolated nucleic acid means that the nucleic acid is not immediately contiguous with both of the sequences with which it is immediately contiguous (one on the 5' end and one on the 3' end) in the naturally occurring genome of the organism from which it is derived. For example, an isolated nucleic acid molecule can be, without limitation, a recombinant DNA molecule of any length, provided nucleic acid sequences normally found immediately flanking that recombinant DNA molecule in a naturally occurring genome are removed or absent. Thus, an isolated nucleic acid molecule includes, without limitation, a recombinant DNA that exists as a separate molecule (e.g., a cDNA or a genomic DNA fragment produced by PCR or restriction endonuclease treatment) independent of other sequences as well as recombinant DNA that is incorporated into a vector, an autonomously replicating plasmid, a virus (e.g., a retrovirus, adenovirus, or herpes virus), or into the genomic DNA of a prokaryote or eukaryote. In addition, an isolated nucleic acid can include a recombinant DNA molecule that is part of a hybrid or fusion nucleic acid sequence.

Typically, regulatory elements are nucleic acid sequences that regulate the expression of other nucleic acid sequences at the level of transcription and/or translation. Thus, regulatory elements include, without limitation, promoters, operators, enhancers, ribosome binding sites, transcription termination sequences (i.e., a polyadenylation signal), and the like. In addition, regulatory elements can be, without limitation, synthetic DNA, genomic DNA, intron DNA, exon DNA, and naturally-occurring DNA as well as non-naturally-occurring DNA. It is noted that isolated nucleic acid molecules containing a regulatory element are not required to be DNA even though regulatory elements are typically DNA sequences. For example, nucleic acid molecules other than DNA, such as RNA or RNA/DNA hybrids, that produce or contain a DNA regulatory element are considered regulatory elements. Thus, recombinant retroviruses having an RNA sequence that produces a regulatory element upon synthesis into DNA by reverse transcriptase are isolated nucleic acid molecules containing a regulatory element even though the recombinant retrovirus does not contain any DNA.

3. Transfection

The term "transfection," of a nucleic acid into a cell, as used herein is intended to include "transformation," "transduction," "gene transfer" and the like, as they are commonly used in the art. "Transfection" is not intended to be limited to transfer of nucleic acid into a cell by means of an infectious particle such as a retrovirus, as the term may have been used originally. Rather any form of delivery and introduction of a nucleic acid molecule, preferably DNA, into a cell, whether in the form of a plasmid, a virus, a liposome-based vector, or any other vector, so that the nucleic acid is expressed in the cell and its protein product(s) made, is included within the definition of "transfection."

When a nucleic acid is said to "encode" a product other than a protein, this language is intended to mean that it encodes the necessary proteins/enzymes that are involved in, or required for, the synthesis of that product. For example, if a DNA molecule is said to encode LPS, it clearly encodes one or more proteins (enzymes) that are involved in the biosynthesis of LPS. If a nucleic acid is said to "encode the biosynthesis" of a structure, it means that the nucleic acid encodes the enzymes that participate in the creation of that structure. In particular for the carbohydrate structures referred to herein, the nucleic acids used in the invention are introduced into a cell that normally does not make, or makes little of, the carbohydrate structure so as to provide to that cell the genetic material for an enzyme or enzymes that generate the carbohydrate structure or modify a different carbohydrate structure to that one indicated.

When transfected in vitro, the cells are autologous, allogeneic, or xenogeneic to the host to provide additional immunogenicity. In addition to being transfected with nucleic acid encoding a SAg, the cells are transfected with nucleic acid encoding any other polypeptide including, without limitation, a galactosyltransferase, staphylococcal hyaluronidase and/or erythrogenic toxin, streptococcal capsular polysaccharide, CD44, tumor antigen, costimulatory molecule such as B7-1 and B7-2, adhesion molecules, MHC class I molecule and/or MHC class II molecule. Nucleic acids encoding the molecules are cotransfected with the SAgs. But for others, including but not limited to Staphylococcal hyaluronidase, erythrogenic toxin, Streptococcal capsular polysaccharide and CD44 genes, the nucleic acids encoding the SAgs are fused to other nucleic acids resulting in expression of a fusion protein. Methods for in vivo and in vitro transfection of cells are well known. For example, two books in the series Methods in Molecular Medicine published by Humana Press, Totowa, N.J., describe in vivo and in vitro transfection protocols that are adaptable to the present invention (Vaccine Protocols edited by Robinson et al., (1996) in Gene Therapy Protocols edited by Robbins et al., Humana Press, Totowa, N, J. (1997)). Transfection protocols are also discussed elsewhere ((Sambrook, J. et al., Molecular Cloning, Second Edition, Cold Springs Harbor Laboratory Press, Plainview, N.Y., (1989)). In addition, use of various vectors to target epithelial cells, use of liposomal constructs, methods of transferring nucleic acid directly into T cells, hematopoietic stem cells, and fibroblasts, methods of particle-mediated nucleic acid transfer to skin cells, and methods of liposome-mediated nucleic acid transfer to tumor cells have been described elsewhere. (Felgner, P L et al., Cationic Lipids for Intracellular Delivery of Biologically Active Molecules, U.S. Pat. No. 5,459,127, issued Oct. 17, 1995; Felgner, P L, Cationic Lipids for Intracellular Delivery of Biologically Active Molecules, U.S. Pat. No. 5,264,618, issued Nov. 23, 1993; Felgner, P L, Exogenous DNA Sequences in a Mammal, U.S. Pat. No. 5,580,859 issued Dec. 3, 1996; Felgner, P L, A Protective Immune Response in a Mammal by Injecting a DNA Sequence, U.S. Pat. No. 5,589,466 issued Dec. 31, 1996).

Nucleic acid and nucleic acid constructs of the present invention are incorporated into a vector, an autonomously replicating plasmid, or a virus (e.g., a retrovirus, adenovirus, or herpes virus). Typically, these vectors, plasmids, and viruses can replicate and function independently of the cell genome or integrate into the genome. Vector, plasmid, and virus design depends on, for example, the intended use as well as the type of cell transfected. Appropriate design of a vector, plasmid, or virus for a particular use and cell type is within the level of skill in the art. In addition, a single vector, plasmid, or virus can be used to express either a single polypeptide or multiple polypeptides. It follows that a vector, plasmid, or virus that is intended to express multiple polypeptides will contain one or more operably linked regulatory elements capable of effecting and/or enhancing the expression of each encoded polypeptide.

The term "operably linked" means that two nucleic acid sequences are in a functional relationship with one another. For example, a promoter (or enhancer) is operably linked to a coding sequence if it effects (or enhances) the transcription of the coding sequence. A ribosome binding site is operably linked to a coding sequence if it is positioned to facilitate translation. Operably linked nucleic acid sequences are often contiguous, but this is not a requirement. For example, enhancers need not be contiguous with a coding sequence to enhance transcription of the coding sequence.

A vector, plasmid, or virus that directs the expression of a polypeptide such as a SAg can include other nucleic acid sequences such as, for example, nucleic acid sequences that encode a signal sequence or an amplifiable gene. Signal sequences are well known in the art and can be selected and operatively linked to a polypeptide encoding sequence such that the signal sequence directs the secretion of the polypeptide from a cell. An amplifiable gene (e.g., the dihydrofolate reductase [DHFR] gene) in an expression vector can allow for selection of host cells containing multiple copies of the transfected nucleic acid.

Standard molecular biology techniques are used to construct, propagate, and express the nucleic acid, nucleic acid constructs, vectors, plasmids, and viruses of the invention ((Sambrook, J. et al., supra; Maniatis et al., Molecular Cloning (1988); and U.S. Pat. No. 5,364,934. For example, prokaryotic cells (e.g., *E. coli, Bacillus, Pseudomonas*, and other bacteria), yeast, fungal cells, insect cells, plant cells, phage, and higher eukaryotic cells such as Chinese hamster ovary cells, COS cells, and other mammalian cells can be used.

4. Sickled Erythrocytes as Gene Carriers

Erythrocytes from patients with sickle cell anemia contain a high percentage of SS hemoglobin which under conditions of deoxygenation aggregate followed by the growth and alignment of fibers transforming the cell into a classic sickle shape. Retardation of the transit time of sickled erythrocytes results in vaso-occlusion. SS red blood cells have an adherent surface and attach more readily than normal cells to monolayers of cultured tumor endothelial cells. Reticulocytes from patients with SS disease have on their surface the integrin complex $\alpha_4\beta_1$ which binds to both fibronectin and VCAM-1, a molecule expressed on the surface of tumor endothelial cells particularly after activation by inflammatory cytokines such as TNF, interleukins and lipid-mediated agonists (prostacyclins). Activated tumor endothelial cells are typically procoagulant. Similar molecules are upregulated on the neovasculature of tumors. In addition, upregulation of the adhesive and hemostatic properties of tumor endothelial cells are induced by viruses, such as herpes virus and Sendai virus. Sickled erythrocytes lack structural malleability and aggregate in the small tortuous microvasculature and sinusoids of tumors. In addition, the relative hypoxemia of the interior of tumors induces aggregation of sickled erythrocytes in tumor microvasculature. Hence, sickled erythrocytes with their proclivity to aggregate and bind to the tumor endothelium are ideal carriers of therapeutic genes to tumor cells.

Red blood cell mediated transfection is used to introduce various nucleic acids into the sickled erythrocytes. The extremely plastic structure of the erythrocyte and the ability to remove its cytoplasmic contents and reseal the plasma membranes enable the entrapment of different macromolecules within the so-called hemoglobin free "ghost." Combining these ghosts and a fusogen such as polyethylene glycol has permitted the introduction of a variety of macromolecules into mammalian cells (Wiberg, F C et al., Nucleic Acid Res. 11: 7287-7289 (1983); Wiberg, F C et al., Mol. Cell. Biol. 6: 653-658 (1986); Wiberg, F C et al., Exp. Cell. Res. 173: 218-227 (1987). Both transient and stable expression of introduced DNA is achieved by this method. Sickled cells can also be transfected with a nucleic acid of choice e.g., apolipoproteins, RGD in the nucleated prereticulocyte phase (e.g. proerythroblast or normoblast stage) by methods given in Example 1. Sickled erythrocytes transfected with nucleic acids encoding a SAg and/or carbohydrate modifying enzyme to induce expression of the a Gal epitope, apolipoproteins, RGD and/or any construct described herein. Nucleic acids encoding additional polypeptides alone or together with SAg as described in Tables I and II to including but not limited to angiostatin, apolipoproteins, RGD, streptococcal or staphylococcal hyaluronidase, chemokines, chemoattractants and Staphylococcal protein A are transfected into and expressed by sickled erythrocytes. These sickled cell transfectants are administered parenterally and localize to tumor neovascular endothelial sites where they induce a anti-tumor response. Protocols for use of these transfectants in the induction of anti-tumor immune response are described in Examples 3, 4, 5, 6, 7.

5. Vesicles from Sickled Erythrocytes

Vesicles from sickled erythrocytes are shed from the parent cells. The contain membrane phospholipids which are similar to the parent cells but are depleted of spectrin. They also demonstrate that a shortened Russell's viper venom clotting time by 55% to 70% of control values and become more rigid under acid pH conditions. Rigid sickle cell vesicles induce hypercoagulability, are unable to pass through the splenic circulation from which they are rapidly removed. Sickled erythrocytes are transfected in the nucleated prereticulocyte phase with superantigen and apolipoprotein nucleic acids as well as RGD nucleic acids. Nucleic acids encoding additional polypeptides alone or together with SAg as described in Tables I and II are transfected into and expressed by sickled erythrocytes. Any of the immature or mature sickled erythrocytes and their shed vesicles expressing the molecules given in Tables I and II are capable of localizing to tumor microvascular sites where they bind to apolipoprotein receptors and induce an anti-tumor effect. Because of their adhesive and hypercoagulable properties as well as their rigid structure, these sickled cell vesicles expressing superantigen and apolipoproteins are especially useful for targeting the tumor microvascular endothelium and producing a prothrombotic, inflammatory anti tumor effect. Sickled erythrocytes and their vesicles are capable of acquiring oxyLDL via fusion with oxyLDL containing liposomes as in Example 5. The resulting sickle cell or liposome expresses oxyLDL alone or together with SAg. Binding of oxyLDL to the SREC receptor on tumor microvascular endothelial cells induces apoptosis and simultaneous superantigen deposition produces a potent T cell anti-tumor effect.

Vesicles are prepared and isolated as follows: Blood is obtained from patients with homozygous sickle cell anaemia. The PCV range is 20-30%, reticulocyte range is 8-27%, fetal hemoglobin range is 25-13% and endogenous level of ISCs is 2-8%. Blood is collected in heparin and the red cells are separated by centrifugation and washed three times with 09% saline. Cells are incubated at 37° C. and 10% PCV in Krebs-Ringer solutions in which the normal bicarbonate buffer is replaced by 20 mM Hepes-NaOH buffer and which contains either 1 mM $CaCl_2$ or 1 mM EGTA. All solutions contain penicillin (200 u/ml) and streptomycin sulphate (100 ug/ml). Control samples of normal erythrocytes are incubated in parallel with the sickle cells. Incubations of 10 ml aliquots are conducted in either 100% $N_2$ or in room air for various periods in a shaking water bath (100 oscillations per mm). $N_2$ overlaying is obtained by allowing specimens to equilibrate for 45 mm in a sealed glove box (Gallenkamp) which was flushed with 100% $N_2$. Residual oxygen tension in the sealed box was less than 1 mmHg. The percentage of irreversibly sickled cells is determined by counting. 1000 cells after oxygenation in room air for 30 mm and fixation in buffered saline (130 mM Cl, 20 mM sodium phosphate, pH 74) containing 2% glutaraldehyde. Cells whose length is greater than twice the width and which possessed one or more pointed extremities under oxygenated conditions are considered to be irreversibly sickled. After various periods of incubation, cells are sedimented at 500 g for 5 mm and microvesicles) are isolated from the supernatant solution by centrifugation at 15,000 g for 15 mm. The microvesicles form a firm bright red pellet sometimes overlain by a pink, flocculent pellet of ghosts (in those cases where lysis was evident) which is removed by aspiration. Quantitation of microvesicles is achieved by resuspension of the red pellet in 1 ml of 05% Triton X100 followed by measurement of the optical density of the clear solution at 550 nm. Optical density measurements at 550 nm give results that are relatively the same as measurements of phospholipid and cholesterol content in the microvesicles. Cell lysis is determined by measurement of the optical density at 550 nm of the clear supernatant solution remaining after sedimentation of the microvesicles. Larger samples of microvesicles for biochemical and morphological analysis are prepared from both sickle and normal cells following incubation of up to 100 ml of cell suspension at 37° C. for 24 h in the absence or presence of $Ca_2$ Ghosts are prepared from sickle cells after various periods of incubation. The cells are lysed and the ghosts washed in 10 mM Tris HCl buffer, pH 73, containing 0.2 mM EGTA.

These vesicles are useful as a preventative or therapeutic vaccine as in Examples 4, 5, 6, 7.

TABLE I

Therapeutic Constructs And Preferred Conditions Of Use

I. CELLS: Tumor Cells, DCs or DC/Tumor Cell Hybrids (DC/tc)
USE: In vivo and Ex vivo
PURPOSE
A. In Vivo Preventative or Therapeutic Vaccine (Established Tumor)
Accomplish by transfecting or co-transfecting with nucleic acid encoding superantigen plus one or more of the following:
1. Superantigens
2. Enzyme that modifies carbohydrate to induce Gal or GalCer epitope expression
3. Functional hyaluronidase from microbial or human sources
4. *Staphylococcal* or *streptococcal* erythrogenic toxin
5. *Staphylococcal* protein a or a domain thereof
6. *Staphylococcal* hemolysin and functional microbial toxins
7. Functional microbial or human coagulase
8. Costimulatory protein
9. Chemoattractants
10. Chemokines
11. Nucleic acids encoding biosynthesis of lipopolysaccharides
12. Nucleic acids encoding biosynthesis of glycosylceramides
13. Nucleic acids encoding biosynthesis of microbial membrane or capsular lipoproteins and polysaccharides
14. Oncogenes, amplified oncogenes and transcription factors
15. Angiogenic factors and receptors
16. Tumor growth factor receptors
17. Tumor suppressor receptors
18. Cell cycle proteins
19. Heat-shock proteins, ATPases and G proteins
20. Proteins engaged in antigen processing, sorting and intracellular trafficking
21. Inducible nitric oxide synthase (iNOS)
22. apolipoproteins (e,g,. Lp(a)) transfected into tumor cells & sickled erythrocytes used for targeting tumor microvasculature
23. LDL and oxyLDL receptors (e.g., SCEP receptor) transfected into tumor cells and sickled erythrocytes & used for targeting to tumor microvasculature
B. Ex Vivo Immunization of T and/or NKT cells to Produce Tumor Specific Effector Cells (for Adoptive Immunotherapy)*
Accomplish by (i) transfecting or co-transfecting tumor or accessory cells with nucleic acid encoding the following, or (ii) providing immobilized molecules or receptors that present the following:
1. Superantigen
2. Superantigen receptor and transcription factor with bound superantigen
3. CD1 receptor binding and/or expressing superantigen-glycosyl ceramide complex
4. CD14 receptor binding or expressing superantigen-lipopolysaccharide or superantigen-peptidoglycan complex
5. Mannose receptor binding glycosylated superantigen
6. Glycophorin receptor
7. Superantigen-tumor peptide(s) complex on MHC or CD1-bearing APC in soluble or immobilized form
C. Therapeutic Molecules or Complex Applied to Transfected or Untransfected Tumor cells or Accessory Cells; or MHC class I, class II, CD1, Superantigen receptor or CD14 receptor:
1. Superantigen (wherein cell may express Gal)
2. Glycosylated superantigen
3. Superantigen complex with
    a. glycosyl ceramide
    b. lipopolysaccharide
    c. peptidoglycan
    d. mannan proteoglycan
    e. muramic acid
    f. tumor peptide
    g. glycosylceramides with terminal Gal($\alpha$1-4)Gal
       e.g. globotriosylceramide and galabiosylceramide
    h. Conjugates of SAg-(Gb2 or Gb3 or Gb4)
    i. Conjugates of SAg-(Gb2 or Gb3 or Gb4)-CD1
    j. GPI anchored conjugates: SAg-GPI-(Gb2 or Gb3 or Gb4)
    l. GPI anchored conjugates: SAg-GPI-(Gb2 or Gb3 or Gb4)-CD1
    m. Conjugates of SAg polypeptide or nucleic acid with Verotoxin
    n. Conjugates of SAg Polypeptide or nucleic acid with Verotoxin A or B subunit
    o. Conjugates of SAg polypeptide or nucleic acid with IFN$\alpha$ receptor peptides homologous to verotoxin
    p. Conjugates of SAg polypeptide or nucleic acid with CD19 peptides homologous to verotoxin
    q. Conjugates of SAg polypeptide or nucleic acid with Arg-Gly-Asp or Asn-Gly-Arg
    r. Conjugates of SAg polypeptide or nucleic acid with LDL, VLDL, HDL
    s. Conjugates of SAg polypeptide or nucleic acid with Apolipoproteins (e.g., Lp(a), apoB-100, apoB-48, apoE)
    t. Conjugates of SAg polypeptide or nucleic acid with oxyLDL, oxyLDL mimics, (e.g., 7$\beta$-hydroperoxycholesterol, 7$\beta$-

TABLE I-continued

Therapeutic Constructs And Preferred Conditions Of Use hydroxycholesterol, 7-ketocholesterol, 5α-6α-epoxycholesterol, 7β-hydroperoxy-choles-5-en-3β-ol, 4-hydroxynonenal (4-HNE), 9-HODE, 13-HODE and cholesterol-9-HODE)
    u.    Conjugates of SAg polypeptide or nucleic acid with oxyLDL by products (e.g. lysolecithin, lysophosphatidylcholine, malondialdehyde, 4-hydroxynonenal)
    v.    LDL & oxyLDL receptors (e.g., LDL oxyLDL, acetyl-LDL, VLDL, LRP, CD36, SREC, LOX-1, macrophage scavenger receptors) as polypeptide or nucleic acid alone or with SAg polypeptide or nucleic acid intratumorally
II.    CELLS: Specialized Tumor Specific Effector Cells (T and/or NKT Cells)
USE:    Adoptive Immunotherapy In Vivo
PURPOSE:
A.    CD44 Expression on T cells or NKT
Accomplished by: (i) Superantigen stimulation; and/or (ii) transfection with nucleic acid encoding CD44 and/or (iii) transfection with nucleic acid encoding glycosyltransferase
B.    Chimeric TCR with:
Invariant a chain site for binding GalCer and
Vβ chain site for binding superantigen
C.    Dual TCR Vβ chains with sites for superantigen binding
D.    T cells or NKT cells with overexpressed Vb region specific for a given superantigen
E.    T cells or NKT cells with lowered signal transduction threshold
III.    MOLECULES: Superantigen mimics
USE:    In Vivo Administration
A.    Superantigen receptor-binding oligonucleotides
B.    Superantigen oligonucleotide-peptide conjugate
Oligo nucleotide is specific for superantigen receptor on tumor cells
Peptide has deleted class II binding site and intact TCR binding site
C.    Phage displayed integrin ligand on tumor neovasculature - carrier for superantigen-encoding nucleic acid.
IV.    CARRIERS: for nucleic acid encoding superantigen
USE    Transfection of Tumors In vivo
A.    Sickled erythrocytes that target tumor neovasculature
B.    Phage displayed tumor neovascular integrin and superantigen receptor carrying superantigen nucleic acids
V.    CARRIERS: constructed to co-express superantigen conjugates or complexes with:
Glycosylceramide
αGal
Lipopolysaccharides
Peptidoglycans
USE    Transfection of Tumor Cells and/or DCs and/or DC/tc's - in vivo or ex vivo.
A.    Liposomes
B.    Proteosomes

TABLE II

Nucleic Acid Constructs and Cells

SAg-encoding DNA is used alone or together with DNA encoding other cell surface moieties useful in generating antitumor immunity. Genes or their products are shown in column 1, source information is shown in column 3, preferred cells to be transformed, transfected or transduced with the DNA are shown in column 2. All of references are incorporated by reference in their entirety.

| Gene or Gene Product | Cells transformed | Reference or Source |
|---|---|---|
| 1. SAg (SEQ ID NOS: 1-2) | Tumor | [See text] |
| 2. Enterotoxin (SEQ ID NOS (3-12) | Tumor | [See text] |
| 3. SAg receptor (SEQ ID NOS 1-2) | Tumor | [See text] |
| 4. Enterotoxin receptor (SEQ ID NOS 3-12) | Tumor | [See text] |
| 5. CD1 receptor(s) (SEQ ID NO 13-14) | Tumor | Martin, LH et al., Proc. Natl. Acad. Sci. 83: 9154-9158 (1986) |
| 6. CD14 receptor (SEQ ID NOS 15-16) | Tumor | Ferrero, E et al., J. Immunol. 145: 331-336 (1990) |
| 7. CD44 encoding nucleic acids (SEQ ID NO 17) | T or NKT | Nottenburg, C et al. Proc. Natl. Acad. Sci. 66: 8521-88525(1992) |
| 8. Carbohydrate modifying enzymes (SEQ ID: NO 18) | Tumor, T or NKT | Sheng, Y et al. Int. J. Cancer 73: 850-858 (1997) |
| 9. TCR Vβ chain (SEQ NOS 19-20) | Tumor | Tillinghast, JP et al., Science 233: 879-883 (1986) |

TABLE II-continued

Nucleic Acid Constructs and Cells
SAg-encoding DNA is used alone or together with DNA encoding other cell surface moieties useful in generating antitumor immunity. Genes or their products are shown in column 1, source information is shown in column 3, preferred cells to be transformed, transfected or transduced with the DNA are shown in column 2. All of references are incorporated by reference in their entirety.

| Gene or Gene Product | Cells transformed | Reference or Source |
|---|---|---|
| 10. Staph/Strep hyaluronidase (SEQ NOS: 21-22) | Tumor | Hynes WL et al., Infect. Immun., 63: 3015-3020 (1995) |
| 11. Staph/Strep erythrogenic toxin (SEQ NOS 23-24) | Tumor | McShan WM, et al., Adv. Exp. Med. Biol. 418: 971-973 (1997) |
| 12. Staphylococcal β-hemolysin (SEQ NOS: 25-26) | Tumor | Projan SJ et al., Nucleic Acid Res. 3305-3309 (1989) |
| 13. Strep capsular polysaccharide (SEQ NOS: 27-28) | Tumor | Lin, WS et al., J. Bacteriol. 176: 7005-7016 (1994) |
| 14. Staph staphylocoagulase (SEQ NOS 29-30) | Tumor | Kaida S. et al., J. Biochemistry 102: 1177-1186 (1987) |
| 15. Staph Protein A (SEQ NOS: 31-32) | Tumor | Shuttleworth, HL et al., Gene 58: 283-295 (1987) |
| 16. Staph Protein A domain D (SEQ NOS: 33-34) | Tumor | Roben, PW et al., J. Immunol. 154: 6347-6445 (1995) |
| 17. Staph Protein A Domain B (SEQ NO: 35) | Tumor | Gouda, H et al., Biochemistry, 31: 9665-9672 (1992) |
| 18. Immunostimulatory protein | Tumor, T or NKT | Tokunaga, T et al., Microbiol. Immunol. 36: 55-66, (1992) |
| 19. Costimulatory protein | Tumor | Entage, PC et al., J.Immunol. 160: 2531-2538 (1998) |
| 20. SAg-mimicking nucleic acid | T or NKT | |
| 21. Glycophorin (SEQ NOS: 36-37) | Tumor | Siebert, PD. et al., Proc. Natl. Acad. Sci. USA 83 1665-1669 (1986) |
| 22. Mannose receptor (SEQ ID NOS 38-39) | Tumor | Kim SJ. et al., Genomics 14: 721-727 (1992) |
| 23. Angiostatin (SEQ ID NO: 40) | Tumor | Cao, Y. et al., J.Clin. Invest 101: 1055-1063 (1998) |
| 24. Chemoattractant (SEQ ID NOS: 41-42) | Tumor | Ames, RS. et al., J. Biol. Chem. 271: 20231-20234 (1996) |
| 25. Chemokine (SEQ ID NOS 43-44) | Tumor | Nagira, M et al., J. Biol. Chem. 272: 19518-19524 (1997) |
| 26. Transcription factor (SEQ ID NO 45) | Tumor, T or NKT | Schwab M et al., Mol. Cell Biol. 6: 2752-2758 (1986) |
| 27. Transcription factor-binding nucleic acid | Tumor, T or NKT | |
| 28. SAg/peptide conjugate | Tumor | |
| 29. Glyco-SAg | Tumor | |
| 30. Staph. global regulator gene agr (SEQ ID NO: 46-48) | Tumor | Balaban, N. et al., Proc. Natl. Acad.Sci. USA 92: 1619-1623 (1995) |
| 31. Lipid A biosynthetic genes (SEQ ID NOS: 49-56) | Tumor | Schnaitman CA et al., ge lpxA-D Microbiological Reviews 57: 655-682 (1993) |
| 32. Mycobacterial mycolic acid biosynthetic genes (SEQ ID NOS: 57-58) | Tumor | Fernandes ND et al., Gene 170: 95-99 (1996); Mathur M et al., J.Biol. Chem. 267: 19388-19395 (1992) |
| 33. c-abl oncogene amplified in chronic myel. Leukemia (SEQ ID NOS: 59-60) | Tumor | Scherle PA et al., Proc. Natl. Acad. Sci. USA 87: 1908 (1990); Heisterkamp N et. al., Nature 344: 251-253 (1990) |
| 34. erbB2 (HER2/neu) oncogene (SEQ ID NOS: 61-62) | Tumor | Schechter AL et al., Science 229: 976 (1985); Bargmann CL Nature 319: 226 (1986); Hung MC et al., Proc. Natl. Acad Sci. 83: 261 (1986); Yamamoto T et al., Nature 319: 230 (1986) |

TABLE II-continued

Nucleic Acid Constructs and Cells
SAg-encoding DNA is used alone or together with DNA encoding other cell surface moieties useful in generating antitumor immunity. Genes or their products are shown in column 1, source information is shown in column 3, preferred cells to be transformed, transfected or transduced with the DNA are shown in column 2. All of references are incorporated by reference in their entirety.

| | Gene or Gene Product | Cells transformed | Reference or Source |
|---|---|---|---|
| 35. | IGF-1 receptor gene (SEQ ID NOS: 63-64) | Tumor | Abbott AM et al., J. Biol. Chem. 267: 10759-10763 (1992); Scott J et al., Nature 317: 260-262 (1985); Liu J et al., Cell 75: 59-63 (1993) |
| 36. | VEGF (SEQ ID NOS: 65-66) | Tumor | Tischer E et al., J. Biol. Chem. 266: 11947-11954 (1991) |
| 37. | Strep emm-like gene family | Tumor | Kehoe MA, In: Cell-Wall Associated Proteins in Gram-Positive Bacteria in Bacterial Cell Wall, Ghuysen JM et al., eds, Elsevier, Amsterdam, 1994 |
| 38. | iNOS (SEQ ID NOS 67-68) | Tumor | Xie QW et al., Science 256: 225-228 (1992) |
| 39. | Apolipoproteins (e.g., Lp(a), apoB-100, apoB-48, apoE) (SEQ ID NOS: 69-74) | Tumor | [See Text] |
| 40. | LDL & oxyLDL receptors (e.g., LDL oxyLDL, acetyl-LDL, VLDL, LRP, CD36, SREC, LOX-1, macrophage scavenger receptors) SEQ ID NOS: (75-86) | Tumor | [See Text] |

6. Superantigens (SAgs)

SAgs are polypeptides that have the ability to stimulate large subsets of T cells. SAgs include Staphylococcal enterotoxins, Streptococcal pyrogenic exotoxins, *Mycoplasma* antigens, rabies antigens, mycobacteria antigens, EB viral antigens, minor lymphocyte stimulating antigen, mammary tumor virus antigen, heat shock proteins, stress peptides, and the like. Any SAg can be used as described herein, although, Staphylococcal enterotoxins such as SEA, SEB, SEC, and SED and streptococcal pyrogenic exotoxins such as toxic shock-associated toxin (TSST-1 also called SEF) are preferred.

When using enterotoxins, the region related to emetic activity can be omitted to minimize toxicity. In addition, SAgs can be derivatized to minimize toxicity. The level of toxicity may not be a concern when using SAg transfected cells to activate lymphocytes ex vivo since the lymphocytes can be rinsed of SAg polypeptide prior to administration to a host.

The nucleic acid sequences that encode SAgs are known and readily available. For example, Staphylococcal enterotoxin A (SEA), SEB, SEC, SED, SEE, TSST-1, and Streptococcal pyrogenic exotoxin (SPEA) have been cloned and can be expressed in *E. coli* (Betley M J and J J Mekalonos, J. Bacteriol. 170:34 (1987); Huang I Y et al., J. Biol. Chem., 262:7006 (1987); Betley M et al., Proc. Natl. Acad. Sci. USA, 81:5179 (1984); Gaskill M E and SA Khan, J. Biol. Chem., 263:6276 (1988); Jones C L and S A Khan, J. Bacteriol., 166:29 (1986); Huang I Y and M S Bergdoll, J. Biol. Chem., 245:3518 (1970); Ranelli D M et al., Proc. Nat. Acad. Sci. USA 82:5850 (1985); Bohach G A, Infect Immun., 55:428 (1987); Bohach G A, Mol. Gen. Genet. 209:15 (1987); Couch J L et al., J. Bacteriol. 170:2954 (1988); Kreiswierth B N et al., Nature, 305:709 (1983); Cooney J et al., J. Gen. Microbiol., 134:2179 (1988); Iandolo J J, Annu. Rev. Microbiol., 43:375 (1989); and U.S. Pat. No. 5,705,151)). Additional nucleic acid sequences encoding SAgs are described elsewhere (Bohach et al., Crit. Rev. in Microbiology 17:251-272 (1990); (Kotzin, B L et al., Advances Immunology 54: 99-165 (1993)) PCR can be used to isolate SAg-encoding acid. For example, the nucleic acid encoding SEA, SEB, and TSST-1 can be isolated as described elsewhere (Dow et al., J. Clin. Invest. 99:2616-2624 (1997)). Briefly, the following primers can be used to amplify the SAg-encoding nucleic acid:

```
SEA forward:     GGGAATTCCATGGAGAGTCAACCAG,                            (SEQ ID NO:87)

SEA backward:    GCAAGCTTAACTTGTTAATAG;                                (SEQ ID NO:88)

SEB forward:     GGGAATTCCATGG-AGAAAAGCG,                              (SEQ ID NO:89)

SEB backward:    GCGGATCCTCACTTTTTCTTTG;                               (SEQ ID NO:90)

TSST-1 forward:  GGGGTACCCCGAAGGAGGAAAAAAAAATGTCTACAAACGATAATATAAAG,   (SEQ ID NO:91)

TSST-1 backward: TGCTCTAGAGCATTAATTAATTTCTGCTTCTATAGTTTTTAT            (SEQ ID NO:92)
```

The full-length TSST-1 nucleic acid sequence is cloned into a eukaryotic expression vector (pCR3; InVitrogen Corp., San Diego, Calif.), whereas only the sequence corresponding to the mature SEB and SEA (sequences minus the putative bacterial signal sequences) is cloned into pCR3. Removal of the SEB and SEA signal sequences increases the level of expression in transfected cells. The plasmids are grown in *Escherichia coli* and plasmid DNA extracted by the modified alkaline lysis method and purified on a CsCl gradient.

Nucleic acids encoding mutant or variant SAgs are also considered nucleic acid sequences encoding SAgs within the scope of the invention. For example, a mutant SAg-encoding acid sequence is engineered such that the resulting SAg is devoid of amino acid residues, e.g., histidine, known to produce toxicity. Likewise, SAg-encoding nucleic acid is engineered to contain or lack sequences that facilitate the selective binding of SAgs to certain Vβ regions of the TCR present on T cells or to ganglioside, mannose (or other carbohydrate) receptor, certain regions of MHC class II, and/or enterotoxin receptors present on tumor cells, antigen presenting cells (APCs), and/or lymphocytes.

Nucleic acid sequences that encode a SAg are also fused, in frame, with nucleic acid that encodes another polypeptide. This larger nucleic acid is termed herein a SAg fusion gene and the resulting polypeptide product is a SAg fusion product. Nucleic acid sequences that are fused to SAg-encoding nucleic acid include, without limitation, nucleic acid sequences that encode tumor antigens, costimulatory molecules, adhesion molecules and MHC class II molecules. The superantigen fusion product is secreted by a transfected cell, expressed on the cell surface or it may remain intracellular in nucleic acid or partly processed form.

SAgs are also isolated and purified from their natural source as well as from a heterologous expression system such as *E. coli* Likewise, SAg-containing polypeptides (e.g., SAg fusion products) are isolated and purified from a heterologous expression system. In addition, *Staphylococcus* strains producing high levels of enterotoxin have been identified and are available. For example, exposing enterotoxin-producing *Staphylococcus aureus* to mutagenic agents such as N-methyl-N-nitro-N-nitrosoguanidine results in a 20 fold increase in enterotoxin production over the amounts produced by the parent wild-type *Staphylococcus aureus* strain (Freedman M A and Howard M B J. Bacteriol., 106:289 (1971)).

7. Tumor Cells or Sickled Erythrocytes and Vesicles Expressing SAg and Apolipoproteins Superantigen nucleic acids are fused in frame to nucleic acids encoding apoproteins including but not limited to apoproteins Lp(a), B-48 and 100 and E3 and transfected into tumor cells in vivo to produce tumor cells expressing superantigens and apoproteins. These tumor cells are recognized by apoprotein receptors in tumor microvasculature. Tumor cells are also transfected ex vivo with the identical nucleic acid constructs. A RGD sequence is added to promote deposition in the tumor microvasculature which are useful. These tumor cell transfectants expressing Sag, apoprotein and RGD bind to apoprotein receptors and integrins respectively expressed in tumor microvasculature wherein they initiate a potent and localized anti-tumor response.

Superantigen nucleic acids together with nucleic acids encoding either apo(a), apoB and apoE4 are also transfected into nucleated sickled erythrocytes (e.g., proerythroblast or normoblast phase) by methods given in Examples 1 and 6. The integrin ligand RGD nucleic acids are transfected into tumor cells or sickled cells to facilitate the localization of the transfected tumor cells and sickled cells to integrins expressed in the tumor neovasculature in vivo (see Example 6). Alternatively, the sickled erythrocytes or tumor cells acquire the apolipoprotein or oxyLDL by coculture with liposomes which express the apolipoprotein or oxyLDL (see Section 7 & Example 5).

These tumor cells or sickle cell transfectants are adminstered parenterally and are capable of trafficking to tumor microvascuature wherein they bind to apolipoprotein and scavenger receptors on endothelial cells and macrophages. The transfectants are phagocytosed by macrophages cells and induce endothelial cell apoptosis. SAgs expressed on the tumor cells and sickle cells also induce a local T cell inflammatory anti-tumor response which envelops the neighboring tumor cells.

These tumor cell and sickle cell constructs are prepared by methods given in Examples 1 & 6 and are useful in vivo against primary and/or metastatic tumors according to Examples 14, 15, 16, 18-23.

EXAMPLES

Example 1

Preparation of Plasmids for Making DNA Templates for any Gene of Interest and the Process of Transfection Mammalian oncogenes, and genes for oncogenic transcription factors, angiogenic factors, growth factor receptors and amplicons as well as bacterial and SAg plasmids and DNA are prepared as described in the text references. When necessary, they are modified to forms suitable for transfection into mammalian tumor cells or accessory cells using methods well described in the art. (Old R W et al., Principles of Gene Manipulation, 5th Ed., Blackwell 1994).

As a representative SAg, enterotoxin B plasmid DNA is prepared by the method of Jones C L et al., J. Bacteriology 166 29-33 (1986) and Ranelli et al., Proc. Natl. Acad. Sci. USA 82:5850-5854 (1985) using the CsCl-ethidium bromide density gradient centrifugation of cleared lysates as described (Clewell, D B et al., Proc. Natl. Acad. Sci. USA 62-1159-1166 (1969)). *S. aureus* chromosomal DNA was isolated as described by Betley M et al., Proc. Natl. Acad. Sci. USA 81: 5179-5183 (1984). *E. coli* HB101 was transformed with plasmid DNA by the $CaCl_2$ procedure of Morrison D A et al., Meth. Enzymol. 68:326-331 (1979). Restriction digests were analyzed by 1% agarose and 5% acrylamide gel electrophoresis using Tris/Borate/EDTA buffer as described in Greene P J et al., Methods Mol. Biol. 7: 87-111 (1974). Additional methods for isolation and cloning of specific bacterial and mammalian plasmid DNA useful in tumor or accessory cell transfection are cited in references given previously in the text or in Snyder L et al., Molecular Genetics of Bacteria, ASM Press, Washington, D.C. (1997); Peters et al., supra; Franks et al., supra.

Suitable template DNA for production of mRNA encoding a desired polypeptide may be prepared using standard recombinant DNA methodology as described in Ausubel F et al. Short Protocols in Molecular Biology 3rd Ed. John Wiley, New York, N.Y. (1995). There are numerous available cloning vectors and any cDNA containing an initiation codon can be introduced into the selected plasmid and mRNA can be prepared from the resulting template DNA. The plasmid can be cut with an appropriate restriction enzyme to insert any desired cDNA coding for a polypeptide of interest. For example the readily available cloning vector pSP64T can be used after linearization and transcription with SP6 RNA polymerase. Smaller sequence may be inserted into the Hind III/EcoTI fragment with T4 ligase. Resulting plasmids are screened for orientation and transformed into *E. coli*. These plasmids are adapted to receive any gene of interest at a unique BglII restriction site which is placed between the two *Xenopus* β-globin sequences.

Subcloning of SEB into pHb-Apr-1-Neo Expression Vector

The Staphylococcal enterotoxin B (SEB) gene has been subcloned into pHβ-Apr-1-neo expression vector. The final construct contained only the coding sequence of SEB and conferred resistance to ampicillin and G-418.

Materials and Methods

PCR:

1. The following two primers are designed and made at Life Technologies, Inc.:

```
Primer SEB1: total 24 bp 5' to 3' GGC.GTC.GAC.ATG.TAT.AAG.AGA.TTA
SalI site

Primer SEB2: total 24 bp 5' to 3' GCC.GGA.TCC.TCA.CTT.TTT.CTT.TGT
BamHI site
```

Both primers were dissolved in filter-sterilized ddH$_2$O to a final concentration of 20 mM (stock solution).

2. The volume (in ml) of reagents for each PCR reaction is listed below:

| Reagent | Exp. 1 | Exp. 2 | Exp. 3 | Exp. 4 | Exp. 5 |
|---|---|---|---|---|---|
| ddH$_2$O | 76 | 72 | 67 | 49 | 59 |
| 10 × PCR buffer | 10 | 10 | 10 | 10 | 10 |
| 10 × dNTP (2 mM stock) | 10 | 10 | 10 | 10 | 10 |
| Primer SEB1 (20 mM stock) | 1 | 5 | 1 | 10 | 10 |
| Primer SEB2 (20 mM stock) | 1 | 1 | 1 | 10 | 10 |
| SEB Template (50 mg stock) | 1 | 1 | 10 | 10 | 0 |
| PfuTurbo Enz | 1 | 1 | 1 | 1 | 1 |
| Final Volume | 100 | 100 | 100 | 100 | 100 |

3. The following cycling parameters were applied:

| | | |
|---|---|---|
| 95° C. | 1 minute | 1 cycle initial denature |
| 95° C. | 45 seconds | denature |
| 52° C. | 1 minute | 20 cycles anneal |
| 72° C. | 1 minute | extension |
| 72° C. | 1 minute | 1 cycle final extension |
| 4° C. | hold | |

4. To verify that the PCR reactions yielded the correct size fragment, 10 ml of the reaction mixture was electrophoresed on a 1% agarose gel in 1×TAE buffer.

Vector

1. The pHb-Apr-1-neo expression vector was spotted on a filter paper.

2. To recover the DNA, the circle was cut out and added to 100 ml of H$_2$O to allow rehydration for 5 minutes. After a brief centrifugation, the supernatant was used to transform *E. coli* XL1Blue (Stratagene), and selected by ampicillin (final concentration 100 mg/ml).

3. To verify that the vector is correct, 4 ampR clones were randomly selected and the clones were cultured in LB amp media. DNA was isolated and digested with SalI, BamHI (single digest) and EcoRI/HindIII (double digest). The digested products were electrophoresed on a 1% agarose gel in 1×TAE buffer. The profile of the restriction digest confirmed that the vector is correct.

Cloning and Verification

1. The correct PCR fragments in experiments 2, 3, and 4 were pooled and gel-purified. A portion of the fragments was digested with restriction enzymes SalI and BamHI, and was ligated into the digested pHb-Apr-1-neo expression vector. The ligation products were transformed into *E. coli* XL1Blue (Stratagene). Insert containing clones were selected by ampicillin.

2. Ten ampicillin resistant clones were randomly selected, cultured in 5 ml of LB amp media, and their plasmid DNA was isolated. Insert containing clones (SEB construct were verified by digesting the DNA with SalI and BamHI restriction endonucleases and electrophoresis at 0.8% agarose gel.

3. One of the SEB constructs (clone #2) was verified by sequencing and aligned with the published SEB sequence. Purified DNA templates from bacteria and human cells are prepared for introduction of plasmid into human and bacterial cells by additional methods given in Ausubel F et al., supra. The plasmid DNA is grown up in *E. coli* in ampicillin containing LB medium. The cells were then pelleted by spinning a 5000 rpm for 10 min. at 5000 rpm., resuspended in cold TE pH 8.0, centrifuged again for 10 minutes. at 5000 rpm., resuspended in a solution of 50 mM glucose, 25 mM Tris-Cl pH 8.0, 10 mM EDTA and 40 mg/ml lysozyme. After incubation for 5-10 min. with occasional inversion, 0.2 N NaOH containing 1% SDS was added, followed after 10 minutes at 0° C. with 3 M potassium acetate and 2 M acetic acid. After 10 more minutes, the material was again centrifuged a 6000 rpm, and the supernatant was removed with a pipet. The pellet was then mixed into 0.6 vol. isopropanol (−20° C.), mixed, and stored at −20° C. for 15 minutes. The material was then centrifuged again at 10,000 rpm for 20 min., this time in an HB4 singing bucket rotor apparatus after which the supernatant was removed and the pellet was washed in 70% EtOH and dried at room temperature. Next, the pellet was resuspended in 3.5 ml TE, followed by addition of 3.4 g CsCl and 350 l of 5 mg/ml EtBr. The resulting material was placed in a quick seal tube, filled to the top with mineral oil. The tube was spun for 3.5 hours at 80,000 rpm in a VTi80 centrifuge. The band was removed and the material was centrifuged again making up the volume with 0.95 g CsCl/ml and 0.1 ml or 5 mg/ml EtBr/ml in TE. The EtBr was then extracted with an equal volume of TE saturated N-Butanol after adding 3 volumes of TE to the band. Next, 2.5 vol. EtOH was added, and the material was precipitated at −20° C. for 2 hours. The resultant DNA precipitate is used as a DNA template.

Transfection of B16F10 Melanoma Cells

G418 sensitivity: B16F10 melanoma cells (B16s) were first tested for sensitivity to G418 which will be used as the selectable marker. At 400 ug/mL G418, B16s did not survive, while 200 and 300 ug/mL allowed some survival.

Transfection:

Lipofectamine was used to produce stably transfected B16s. The conditions for transfection were those described protocol provided by Life Technologies. B16s were plated at 4×105 cells/well in 6 well plates, using Murine Complete Medium (MCM) described in Report 2. Cells were cultured overnight. Optimal density is 50-80% confluent and is usually achieved by 18-24 after seeding at 1-3×105 cells/well. DNA sources consisted of SEB-G418 resistance containing vector, vector DNA with G418 resistance gene only, and control DNA from PSK401 (no G418 resistance marker). DNA concentrations were determined for the SEB containing and control vectors.

| DNA source | A260 | DNA (ug/ml) |
| --- | --- | --- |
| SEB | 0.09 | 0.45 |
| Vector only | 0.13 | 0.65 |
| PSK 401 | 0.15 | 0.75 |

Lipofectamine solutions and DNA solutions were prepared in 12×75 mm tubes, using OPTI-MEM (Life Technologies 31985). DNA solutions contained approximately 2 ug in 100 uL OPTI-MEM; the LIPOFECTAMINE Reagent was diluted by adding 6 or 12 uL to OPTI-MEM at a final volume of 100 uL. The solutions were mixed and held at room temperature for 30 minutes. Specific DNA and Lipofectamine conditions were as follows:

Plated cells were rinsed once with 2 ml/well OPTI-MEM. To the above tubes, 0.8 mL OPTI-MEM. This mixture was then overlayed onto the washed cell monolayers according to the above well designations. Cells were incubated for 5 hours at 37° C. in 5% CO2. Murine Complete Medium with 20% FBS but no antibiotics was then added at 1 ml/well. Cultures were refed with standard MCM, at 3 mL/well, after 24 hours. Three days after transfection, cells from each transfection condition were subcultured by splitting the total cell suspension 90:10 into 150 mm plates (one plate received 90% of the cell suspension, the other received the remaining 10%).

G418 selection

All plates were refed at 6 days after transfection with medium containing 400 ug/mL G418. Plates were refed every 2 to 3 days with G418 containing medium until day 17 after transfection. No growth was observed in wells 1-4 as expected. Plates initiated with 90% of the cell suspension and showing growth were harvested, frozen, and stored at −80° C.

Primary Subcloning

Ten colonies were selected from each well for wells 5, 7, 9, and 11. Subcloning was accomplished by the use of cloning cylinders as follows: After seating the cylinder, medium was aspirated and the isolated colony was washed once with 100 uL of warmed trypsin-EDTA. This was aspirated and replaced with fresh tyrpsin-EDTA. After incubation at 37° C. for 2 minutes, the cells were recovered by trituration and transferred to a tube containing 1 ml MCM, then replated by addition of 20 uL of cell suspension to 15 mL MCM with G418 in 150 mm plates. The remaining cell suspension was plated into 24 well plates, 4 wells/clone and all plates were maintained at 37° C., 5% CO2. The 6 well plates were used to assess SEB expression on the cell surface as described under Detection of positive clones.

Secondary and Tertiary Subcloning and Preparation of Frozen Stocks

These and all subsequent procedures were performed by me. Secondary subcloning was performed as above at 7 days after initiation of primary subclones. One colony/plate was selected for further subcloning (a total of 40 colonies). The cell suspension was prepared in a total volume of 1 mL; 100 uL was replated into 100 mm plates containing 10 mL MCM with G418. The remaining cell suspension was plated in 96 well plates at 100/well, 2 replicates for assay. The 96 well plate was used for detection of intracellular expression of SEB described under Detection of positive clones.

Primary subcloning plates were cultured one additional day, then harvested, frozen, and stored at −80° C. These frozen stocks are designated primary subclones. Secondary subclones were refed after 4 days. Of 40 secondary clones, 36 regrew. Tertiary subcloning was performed after 8 days and frozen stocks of secondary clones were prepared after 9 days. Tertiary clones were refed after 3 days in culture and subcultured after 7 days in culture. Plates were harvested, cells were resuspended in a total of 1 mL, and replated by addition of 100 μL of the cell suspension to 100 mm plates with 15 mL MCM or 100 μL/well in a 96 well plate. Frozen stocks of tertiary clones were prepared.

Generation of Conditioned Medium for Assay of Supernatents

After 7 days, 100 mm plates of tertiary clones were again replated. This time, cell counts were performed and $4.5\times10^5$ cells were plated in 12 well plates, one well/clone. The remaining cell suspension was frozen and stored at −80° C. After 4 days in culture, supernatants were harvested, stored at 4° C., and the cells were replated into 100 mm plates. Supernatents were obtained from the 100 mm plates after 7 days in culture. Frozen stocks were also generated from these plates.

Development of ELISA with HRP Rabbit Anti-SEB.

Final ELISA conditions were as follows:

| | |
|---|---|
| Assay Plate | ProBind (Falcon #3915) |
| Capture Antibody | Rabbit anti-SEB (Toxin Technologies # LBI202), 10 ug/mL in PBS, 50 uL/well, 1 hr, RT |
| Wash | 3X with 0.1% casein, 0.1% Tween 20 in PBS |
| Blocking | 1% casein in PBS, 250 uL/well, overnight, 4° C. |
| Antigen | Supernatant used neat or SEB diluted in PBS, 50 μL/well, 2 hr, RT |
| Wash | As above |
| Primary Ab | HRP Rabbit anti-SEB (Toxin Technologies # LBC202), 1/300 in block buffer, 50 μL/well, 2 hr, RT |
| Substrate | OPD, 2.5 mg/mL in citrate buffer, pH 5.0, 0.03% $H_2O_2$, 100 μl/well, 15 min, RT |
| Stop | 4 M H2SO4, 100 μL/well |
| Read-out | OD 490 nm |

Results: SEB produced a dose response curve (linear range 60 fg-60 pg/mL) and the background was very low. Vector only clones produced only background signals. One SEB transfected clone produced a strong signal, three produced moderate signals, and one other produced a weak but definite signal.

| | OD 490 nm | | | | | |
|---|---|---|---|---|---|---|
| | SEB+ | | | Vector only | | |
| | 1 | 2 | mean | 1 | 2 | mean |
| 9.1 | 0.097 | 0.112 | 0.104 | 0.079 | 0.102 | 0.091 |
| 9.2 | 0.127 | 0.123 | 0.125 | 0.081 | 0.076 | 0.078 |
| 9.3 | 0.109 | 0.104 | 0.106 | 0.087 | 0.070 | 0.079 |
| 9.4 | 0.444 | 0.393 | 0.418 | 0.077 | 0.077 | 0.077 |
| 9.5 | 0.163 | 0.087 | 0.125 | 0.075 | 0.074 | 0.074 |
| 9.6 | 0.516 | 0.522 | 0.519 | 0.066 | 0.064 | 0.065 |
| 9.7 | 0.087 | 0.091 | 0.089 | 0.096 | 0.084 | 0.090 |
| 9.8 | 0.386 | 0.450 | 0.418 | 0.080 | 0.071 | 0.075 |
| 9.9 | 0.137 | 0.122 | 0.130 | 0.071 | 0.070 | 0.071 |
| 11.1 | 0.083 | 0.075 | 0.079 | 0.068 | 0.078 | 0.073 |
| 11.2 | 1.847 | 1.802 | 1.824 | 0.063 | 0.076 | 0.070 |
| 11.3 | 0.071 | 0.077 | 0.074 | 0.076 | 0.074 | 0.075 |
| 11.4 | 0.087 | 0.084 | 0.086 | 0.083 | 0.085 | 0.084 |
| 11.5 | 0.161 | 0.220 | 0.191 | 0.092 | 0.086 | 0.089 |
| 11.8 | 0.221 | 0.100 | 0.160 | 0.080 | 0.081 | 0.080 |
| 11.9 | 0.080 | 0.091 | 0.085 | 0.077 | 0.072 | 0.074 |
| 11.10 | 0.290 | 0.254 | 0.272 | 0.081 | 0.112 | 0.097 |
| 11.10 | 0.268 | 0.263 | 0.265 | 0.093 | 0.114 | 0.103 |

Based on the SEB standard curve, the following concentrations were derived.

| Clone number(pg/ml) | SEB |
|---|---|
| 11.2 | 4.146 |
| 9.6 | 0.152 |
| 9.4 | 0.118 |
| 9.8 | 0.118 |
| 11.10 | 0.081 |

Cells are transfected ex vivo or in vivo and implanted in a cancer-bearing host. These transfected cells are also used to stimulate host lymphocytes ex vivo. Once activated, the lymphocytes are administered to the host. The ex vivo or in vitro introduction of DNA into cells is accomplished by methods that (1) form DNA precipitates which are internalized by the target cell; (2) create DNA-containing complexes with charge characteristics that are compatible with DNA uptake by a target cell; or (3) result in the transient formation of pores in the plasma membrane of a target cell exposed to an electric pulse (these pores are of sufficient size to allow DNA to enter the target cell).

Generally, two factors determine the method used: the duration of expression required (i.e., transient versus stable expression) and the type of cell to be transfected. The specific details of exemplary procedures are described herein. Transfections are carried out by well established methods including calcium phosphate precipitations, DEAE Dextran transfection, and electroporation.

Calcium Phosphate Precipitation

A commonly used ex vivo and in vitro method to transfer DNA into recipient cells involves the co-precipitation of the DNA of interest with calcium phosphate. With this technique, DNA enters the cell in sufficient quantities such that the treated cells are transformed with relatively high frequency. Using a variety of cell types, transfection efficiencies of up to 10-3 have been obtained. This is the method of choice for the generation of stable transfectants.

Variations of the basic technique have been developed. If the transfection involves the transfer of plasmid DNA, then high molecular weight genomic DNA isolated from a defined cell or tissue source can be included. The addition of such DNA, called carrier DNA, often increases the efficiency of transfection by the plasmid DNA. Upon arrival of the plasmid DNA/carrier DNA/calcium phosphate co-precipitate to the nucleus of the treated cell, the plasmid DNA integrates into the carrier DNA, often in the tandem array, and this assembly of plasmid and carrier DNA, called a transgenome, subsequently integrates into the chromosome of the host cell.

Another procedural option is the addition of a chemical shock step to the transfection protocol. Either dimethylsulfoxide or glycerol are appropriate. The optimal concentrations and lengths of treatment vary according to cell type. The use of these agents dramatically affect cell viability and can be optimized as described elsewhere [Chen and Okayama, Mol. Cell. Biol. 7:2745 (1987)]. Specifically, incubation of cells with the co-precipitate is optimal at 35° C. in 2-4% $CO_2$ for 15-24 hours. In addition, circular DNA is more active than linear DNA and a finer precipitate is obtained when the DNA concentration is between 20-30 mg/ml in the precipitation mix.

It is noted that incubator temperature, $CO_2$ concentration, and DNA concentration can be varied to obtain the desired result. In addition, the temperature and $CO_2$ concentrations described below are not optimal for cell growth and should be maintained only temporarily.

Method

Day 1: $1.3 \times 10^6$ cells are seeded per 100-mm dish. Cells are about 75% confluent when used to seed the dishes.

Day 2: A large calcium phosphate cocktail mixture to transfect many plates simultaneously is prepared. This protocol is given for 1 ml (or 1×100-mm dish equivalent) of solution. These amounts are scaled up as necessary, allowing for an appropriate amount of sample-transfer errors. Adherence to sterile technique is critical. Sterile reagents, tips, and tubes are used.

1. Add 1-20 g DNA (1 mg/ml in sterile TE, 10 mM Tris-HCl 1 mM EDTA pH 7.05) to 0.45 ml sterile $H_2O$, Note: First "sterilize" DNA by ethanol precipitation with NaCl (0.1M final aqueous concentration) and 2× volume 200% ethanol.

2. Add 0.5 ml 2×HEPES buffered saline. Mix well.

3. Add 50 ml of 2.5 M $CaCl_2$, vortex immediately.

4. Allow the DNA mixture to sit undisturbed for 15-30 minutes at room temperature.

5. Add 1 ml of the DNA transfection cocktail directly to the medium in the 100-mm dish (plated with cells on day 1).

6. Incubate the dishes containing the DNA precipitate for 16 hours at 37° C. Remove the media containing the precipitate and add fresh complete growth media.

7. Allow the cells to incubate for 24 hours. Post-incubation, the cultures can be split for subsequent selection. Split cultures 1:5; however, to isolate individual colonies for further analysis, split cultures 1:10 and 1:100.

DEAE Dextran Transfection

Typically, DEAE dextran transfection is used to transiently transfect cells in culture. This method is highly efficient and the DNA/DEAE dextran mixture used for transfection is relatively easy to prepare. For example, this method yields transfection efficiencies of as high as 80 percent. DNA introduced into cells with this method, however, appears to undergo mutations at a higher rate than that observed with calcium phosphate-mediated transfection.

Method

Briefly, a DEAE dextran mixture is prepared and the DNA sample of interest is added, mixed, and then transferred to the cells in culture.

Day 1: Cells are seeded at a concentration of $2 \times 10^4$ cells/cm2 in a total volume of 2 ml/well ($1.92 \times 10^5$ cells/well of a six-well cluster dish). Cells should be about 75% confluent when used to seed the dishes.

Day 2: Resuspend 0.5 ml DEAE Dextran in Tris-buffered saline (TBS).

Final DEAE Dextran concentration should be about 0.04%. Observe cell monolayers microscopically. Cells should appear about 60-70% confluent and well distributed. Bring all reagents to room temperature. Aspirate off growth media and wash monolayer once with 3 ml of phosphate buffered saline (PBS), followed by one wash with 3 ml of TBS. Aspirate off TBS solution and add 100-125 ml of the appropriate DNA/DEAE-Dextran/TBS mixture to the wells. Incubate dishes at room temperature inside a laminar flow hood. Rock the dishes every 5 minutes for 1 hour, making sure the DNA solution covers the cells. After the 1-hour incubation period, aspirate off the DNA solution and wash once with 3 ml of TBS followed by 3 ml of PBS. Remove the PBS solution by aspiration and replace with 2 ml of complete growth media containing 100 M chloroquine. Incubate the dishes in an incubator set at 37° C. and 5% $CO_2$ for 4 hours. Remove the media containing chloroquine and replace with 2-3 ml of complete growth media (no chloroquine). Incubate the transfected cells for 1-3 days, after which the cells will be ready for analysis. The exact incubation period depends on the intent of the transfection. Optimal expression typically occurs at 3 days post-transfection.

Electroporation

Electroporation is a process whereby cells in suspension are mixed with the DNA to be transferred. This cell/DNA mixture is subsequently exposed to a high-voltage electric field. This creates pores in the membranes of treated cells that are large enough to allow the passage of macromolecules such as DNA into the cells. Such DNA molecules are ultimately transported to the nucleus and a subset of these molecules are integrated into the host genome. The reclosing of the membrane pores is both time and temperature dependent and thus is delayed by incubation at 0° C., thereby increasing the probability that the molecule of interest will enter the cell.

Electroporation appears to work on virtually every cell type. With this technique, the efficiency of nucleic acid transfer is high for both transient transfection and stable transfection. One important technical difference between electroporation and other competing technologies is that the number of input cells required for electroporation is considerably higher.

Method

1. Harvest exponentially growing cells such as tumor cells or accessory cells by trypsinization, pellet, and wash twice with electroporation buffer (Kriegler, M. Gene Transfer and Expression, W.H. Freeman and Co., New York, N.Y. (1991)).

2. Resuspend cells in electroporation buffer at a concentration of $2\text{-}20 \times 10^6$ cells/ml in an electroporation cuvette.

3. Add 5-25 mg of DNA that has been linearized to the cell suspension

4. Insert or connect the electroporation electrode according to the manufacturer's instructions and subject cell/DNA mixture to an electric field (pulse).

5. Return cell/DNA mixture to ice and incubate for 5 minutes.

6. Plate cells in non-selective medium. Biochemical selection may be carried out 24-48 hours later.

Lipofectamine

In vitro cell transfections can be done in 12-well plates, using 3.0 g plasmid DNA and Lipofectamine (GIBCO BRL), at 37° C. for 4 hours. After transfection, the cells are cultured in 2.0 ml complete medium for 48 hours and the cells are harvested. The cells are then washed in PBS. Stably transfected Chinese hamster ovary (CHO) and B16 lines are isolated by selection in 1.0 mg/ml G418 (GIBCO BRL). Cells are grown and passaged in medium containing G418 for 3-4 weeks Mock transfected cell lines (cells transfected with vector only) are used as controls.

Viral Vectors

Recombinant viral vectors containing the nucleic acid of interest can also be used to introduce nucleic acid into a cell ex vivo or in vitro. It is noted that viral vectors are also used to transfect cells in vivo. These viral vectors can be DNA viruses such as herpesviruses, adenoviruses, and vaccinia viruses or RNA viruses such as retroviruses. The method and materials required to produce and use these viral vectors ex vivo, in vitro, and in vivo are commonly known in the art and are used in the invention described herein (Sambrook, J. et al., supra).

Selection

Regardless of the method used to transfect a particular cell type, stably transfected cells are identified as follows. The DNA of interest contains a selectable marker. Typically, a selectable marker encodes a polypeptide that confers drug resistance and the DNA containing this resistance conferring nucleic acid is transfected into the recipient cell. Post transfection, the treated cells are allowed to grow for a period of time (24-48) hours to allow for efficient expression of the selectable marker. After an appropriate incubation time, transfected cells are treated with media containing the concentration of drug appropriate for the selective survival and expansion of the transfected and now drug resistant cells.

Many drug as well as non-drug selection methods are known in the art and can be used in the invention described herein. For example, a detailed description of currently available drug selection strategies is provided in Kriegler M., Gene Transfer and Expression, A Laboratory Manual, W.H. Freeman and Co. New York, N.Y. pp. 103-107 (1991).

General Method

Sixteen hours after transfection, the transfected/infected cells are fed with fresh, non-selective media. Twenty-four to forty-eight hours later, the cultures are split to a 1:5 or greater dilution and plated in drug-containing media. It is noted that cells are not placed in drug-containing media immediately after transfection in order to allow a sufficient amount of time for the drug resistance nucleic acid to be expressed and thus confer the drug resistant phenotype. Cell cultures are re-fed with drug-containing media every three days, at which time cultures are examined under a microscope to determine the efficiency of drug selection.

Site-Directed Mutagenesis by Polymerase Chain Reaction:

Introduction of Restriction Endonuclease Sites by PCR

PCR is the preferred method for introducing any desired sequence change into the DNA.

The basic protocol is as follows:

Materials

DNA sample to be mutagenized, pUC19 plasmid b vector or similar high-copy number plasmid having M13 flanking primer 500 ng/ml (100 µM/µl) flanking sequence primers incorporating the restriction enzyme site TE buffer 10× amplification buffer 2 mM 4dNTP mix 500 ng/ml (100 µM/ml) M13 flanking sequence primers: forward (NEB) and reverse (NEB)

5 U/ml Taq DNA polymerase

Mineral oil

Chloroform

Buffered phenol

100% ethanol

Appropriate restriction endonucleases 500 ml microcentrifuge tube

Automated thermal cycler

1 Subclone DNA to be mutagenized into high-copy number vector using restriction sites flanking the area to be mutated.
2. Prepare template DNA by plasmid miniprep. Resuspend 100 ng in TE buffer to 1 ng/ml final.
3. Synthesize oligonucleotide primers and purify by denaturing polyacrylamide gel electrophoresis. Resuspend oligonucleotides in 500 l TE buffer. Determine absorbance at A260 and adjust to 500 ng/ml.
4. Combine the following in each of two 500 l microcentrifuge tubes, adding oligonucleotides 1 and 2 to separate tubes:

10 ml (10 ng) template DNA 10 ml 10× amplification buffer 10 ml 2 mM 4dNTP mix 1 ml (500 ng) oligonucleotide 1 or 2 (100 pM final)

1 ml (500 ng) appropriate M 13 flanking sequence primer, forward or reverse (100 pM final).

H$_2$O to 99.5 µl 0.5 ml Taq DNA polymerase (5 U/ml)

Overlay reaction with 100 ml mineral oil.
5. Carry out PCR in an automated thermal cycler for 20 to 25 cycles under the following conditions:

45 sec 93° C.

2 min 50° C.

2 min 72° C.

After last cycle, extend for an additional 10 min at 72° C.
6. Analyze 4 l by nondenaturing agarose or occurrence gel electrophoresis to verify that the amplification has yielded the predicted product.
7. Remove mineral oil and extract once with chloroform to remove remaining oil. Extract with buffered phenol and concentrate by precipitation with 100% ethanol.
8. Digest half the amplified DNA with the restriction endonucleases for the flanking and introduced sites. Purify digested fragments on a low gelling/melting agarose gel.
9. Ligate and subclone both fragments into an appropriately digested vector to obtain a recombinant plasmid containing a single DNA fragment incorporating the new restriction site.
10. Transform plasmid into E. coli. Prepare DNA by plasmid miniprep.
11. Analyze amplified fragment portion of plasmid by DNA sequencing to confirm the addition of the mutation.

Introduction of Point Mutation by PCR:

Materials

DNA sample to be mutagenized

Oligonucleotide primers incorporating the point mutation

Klenow fragment of E. coli DNA polymerase I

Appropriate restriction endonuclease

Procedure

1. Prepare template DNA (steps 1 and 2 of Basic Protocol).
2. Synthesize and purify oligonucleotide primers (3 and 4).
3. Amplify template DNA (steps 4 and 5 of Basic Protocol 1). After final extension step, add 5 U Klenow fragment and incubate 15 min at 30° C.).
4. Analyze and process reaction (steps 6 and 7 of Basic Protocol).
5. Digest half the amplified fragments with the restriction endonucleases for the flanking sequences. Purify digested fragments on a low gelling/melting agarose gel.
6. Subclone the two amplified fragments into an appropriately digested vector by blunt-end ligation.
7. Carry out steps 10 and 11 of Basic Protocol.

Introduction of a Point Mutation by Sequential PCR Steps

1. Prepare the template DNA (steps 1 and 2 of Basic Protocol 1).
2. Synthesize and purify the oligosaccharide primers (5 and 6).
3. Amplify the template and generate blunt-end fragments (step 3 of Basic Protocol).
4. Purify fragments by nondenaturing agarose gel electrophoresis. Resuspend in TE buffer at 1 ng/ml.
5. Combine the following in 500 ml microcentrifuge tube:

10 ml (10 ng) each amplified fragment 1 ml (500 ng) each flanking sequence primer (each 100 pM final)

10 ml 10× amplification buffer 10 ml 2 mM4dNTPmix 0.5 ml Taq DNA polymerase (5 U/ml)

Overlay with 100 ml mineral oil.
6. Carry out PCR for 20 to 25 cycles (step 5 of Basic Protocol 1). Analyze and process the reaction mix (steps 6 and 7 of Basic Protocol 1).

7. Digest cDNA fragment with appropriate restriction endonuclease for the flanking sites. Purify fragment on a low gelling/melting agarose gel. Subclone into an appropriately digested vector.

8. Carry out steps 10 and 11, Basic Protocol 1.

Genomic Targeting and Genetic Conversion in Cancer Therapy

A number of cellular transformations are due, in large part, to a single base mutation that alters the function of the expressed protein. Alterations in the DNA sequence of a gene involved in cell proliferation can have a significant effect on the viability of particular cells. Thus, the capacity to modulate the base sequence of such a gene would be a useful tool for cancer therapeutics. An experimental strategy that centers around site-specific DNA base mutation or correction using a unique chimeric oligonucleotide has been developed. This chimeric molecule has demonstrated higher recombinogenic activities than identical oligonucleotides containing only DNA residues, both in vitro and in vivo. The chimeric molecule is designed to hybridize to a target site within the genome and induce a single base mismatch at the residue targeted for mutation. The DNA structure created at this site is recognized by the host cell's repair system which mediates the correction reaction. For example, the bcr-abl fusion gene, the product of a translocation between human chromosomes 9 and 22, and the cause of chronic myelogenous leukemia (CML) can be targeted for gene correction. Fusion genes or mutations which abound in cancer cells are excellent targets for correction especially if (1) they are unique and are recognized by the immune system as dominant or subdominant epitopes, (2) they are a single copy target; (3) the DNA sequence of the fusion gene or mutation is unique. The goal of such experiments is to knock-out the fusion gene by changing an amino acid codon into a stop codon through a chimeric directed DNA repair system.

Targeted Gene Correction of Episomal DNA in Mammalian Cells Mediated by a Chimeric RNA/DNA Oligonucleotide An experimental strategy to facilitate correction of single-base mutations of episomal targets in mammalian cells has been developed. The method utilizes a chimeric oligonucleotide composed of a contiguous stretch of RNA and DNA residues in a duplex conformation with double hairpin caps on the ends. The RNA/DNA sequence is designed to align with the sequence of the mutant locus and to contain the desired nucleotide change. Activity of the chimeric molecule in targeted correction is used in a with the aim of correcting a point mutation in the gene encoding the human liver/bone/kidney alkaline phosphatase. When the chimeric molecule is introduced into cells containing the mutant gene on an extra-chromosomal plasmid, correction of the point mutation is accomplished with a frequency approaching 30%. These results extend the usefulness of the oligonucleotide-based gene targeting approaches by increasing specific targeting frequency.

The site directed mutagenesis is used to carry out using the chimeric DNA/RNA structure which enables the construct to target tumor cells in vivo and in vitro. Such targeting structures include target seeking moieties and can in principle be any structure that is able to bind to a cell surface structure or that binds via biospecific affinity. The target seeking moiety is primarily a disease specific structure selected among hormones, antibodies, growth factors. The biospecific affinity counterpart may include interleukins (especially interleukin-2) antibodies (full length antibody, Fab, F(ab'$_2$), Fv, single chain antibody and any other antigen binding antibody fragments (such as Fab) directed to a cells surface epitope or more preferably towards the binding epitope for the a specific antibody. They may also include polypeptides binding to the constant domains of immunoglobulins (e.g., protein A and G and L), lectins, streptavidin, biotin etc. The term antibodies comprises monoclonal as well as polyclonal preparations. The targeting moiety may also be directed toward unique structures on more or less healthy cells that regulate or control the development of a disease. or ligands for specific receptors on tumor cells). The targeting structure may be a nucleic acid, lipid or carbohydrate and variations thereof which target receptors on the diseased cell. The targeting is not confined to diseased cells but may include additional normal cells as well.

Example 2

Cells Transfected with Nucleic Acids Encoding SAgs

Cultured VX-2 carcinoma cells were shown to retain their tumorigenic activity after implantation into New Zealand white rabbits. Progressive tumor outgrowth was observed over a 3 week period. Nucleic acid encoding SEB isolated and characterized by Gaskill et al., J. Biol. Chem. 263:6276 (1988) and Ranelli et al., Proc. Natl. Acad. Sci. USA 82:5850 (1985) were used to transfect tissue cultured VX-2 carcinoma cells using transfection methodology described in Example 1. Transfectants were selected using G418 and the survival of SEB-transfected VX-2 carcinoma cells was observed. In additional experiments, attempts were made to transfect murine 205 and 207 tumor cells with nucleic acid encoding SEB (the kind gift from Dr. Saleem Khan) and Streptococcal pyrogenic exotoxin A (the kind gift of Dr. Joseph Ferretti). Successful transfection of murine MCA 205 and B16 cells by nucleic acids encoding SEA and SEC2 was achieved shortly thereafter by integrating the SAg DNA into several retroviral vectors (MFG NEO) containing a growth hormone leader sequence under the control of a chick B-actin promoter (Krause J C et al., J. Hematotherapy 6: 41-51 (1997)). In addition, murine tumors MCA 205 fibrosarcoma cells and a spontaneous mammary carcinoma cells were successfully transfected with nucleic acids encoding SEB (provided by Dr. Saleem Khan) using the β-actin promoter. Transfected mammary carcinoma cells induced T cell proliferation in vitro. To demonstrate the anti-tumor capacity of tumor cells transfected with nucleic acid encoding a SAg, these transfectants were injected i.p. into syngeneic hosts with established mammary carcinomas. These transfectants demonstrated a capacity to reduce micrometastases of wild type mammary tumor in vivo assessed in a clonogenic lung metastases assay. The anti-tumor effect produced by the SEB transfectants was enhanced significantly by the co-administration of tumor cells transfected with nucleic acids encoding the costimulating molecule B7-1.

Example 3

Pharmaceutical Compositions and their Manufacture

A preferred delivery system is the sickled erythrocyte containing the nucleic acids of choice a given in Example 6. The sickled erythrocytes undergo ABO and RH phenotyping to select compatible cells for delivery. The cells are delivered intravenously or intrarterially in a blood vessel perfusing a specific tumor site or organ e.g. carotid artery, portal vein, femoral artery etc. over the same amount of time required for the infusion of a conventional blood transfusion. The quantity of cells to be administered in any one treatment would range from one tenth to one half of a full unit of blood. The treatments are generally given every three days for a total of twelve treatments. However, the treatment schedule is flexible and may be given for a longer of shorter duration depending upon the patients response.

Example 4

General Procedures for Administering Constructs in Human Tumor Models and Human Patients The constructs described herein are tested for therapeutic efficacy in several well established rodent models which are considered to be highly representative as described in "Protocols for Screening Chemical Agents and Natural Products Against Animal Tumors and Other Biological Systems (Third Edition)", Cancer Chemother. Reports, Part 3, 3: 1-112, which is hereby incorporated by reference in its entirety. Additional tumor models of carcinoma and sarcoma originating from primary sites and prepared as established tumors at primary and/or metastatic sites are utilized to test further the efficacy of the constructs.

Example 5

General Procedures for Administering Tumor Cells or Sickled Erythrocytes Transduced with SAgs and SAg-Activated T or NKT Cells in Human Tumor Models and Human Patients A. Tumor Cells Transduced with SAg Nucleic Acids alone or Cotransfected with Oncogenes or Nucleic Acids Encoding Potent Immunogens and Bacterial Products In a representative protocol, using the B16 melanoma or A20 lymphoma or other models given above, $10^5$-$10^7$ transfected tumor cells are implanted subcutaneously and 1-6 months later $10^5$-$10^7$ untransfected tumor cells, are implanted. In the case of tumor cells cotransfected with several therapeutic nucleic acids, controls are established consisting of groups transfected with only one of the nucleic acids. These single transfectants are administered on the same schedule as the cotransfectants and assessed for capacity to prevent or reverse tumor growth compared to positive controls receiving tumor alone. The animals receiving the SAg transfected tumor cells show no evidence of growth of the wild type tumor and prolonged survival compared to the controls in which there is 100% appearance of the tumors. The differences are statistically significant. SAg transfected tumor cells are also used to treat established tumors as follows. Transfected tumor cells, $10^5$-$10^7$ are given 3-10 days after the appearance of established tumors. Results show statistically significant arrest of tumor growth, prolongation of survival in treated animals compared to untreated controls.

B. SAg-Activated Effector T or NKT Cells

Effector T or NKT cells are generated as described elsewhere and are infused intravenously in doses of $10^6$-$10^8$ into syngeneic hosts that have pulmonary metastatic lesions established by injecting tumor cells intravenously 3 to 12 days earlier. Twenty days later, the animals are sacrificed and pulmonary metastases measured in treated animals compared to untreated controls. Results show statistically significant reduction in total number of pulmonary nodules and prolonged survival in the treated group compared to untreated controls.

Example 6

General Test Evaluation Procedures for Constructs and SAg Activated Effector T or NKT Cells I. General Test Evaluation Procedures A. Calculation of Mean Survival Time Mean survival time is calculated according to the following formula:

$$\text{Mean survival time (days)} = \frac{S + AS_{(A-1)} - (B+1)NT}{S_{(A-1)} - NT}$$

DEFINITIONS

Day: Day on which deaths are no longer considered due to drug toxicity. Example: with treatment starting on Day 1 for survival systems (such as L1210, P388, B16, 3LL, and W256):

Day A: Day 6.

Day B: Day beyond which control group survivors are considered "no-takes."

Example: with treatment starting on Day 1 for survival systems (such as L1210, P388, and W256), Day B-Day 18. For B16, transplanted AKR, and 3LL survival systems, Day B is to be established.

S: If there are "no-takes" in the treated group, S is the sum from Day A through Day B. If there are no "no-takes" in the treated group, S is the sum of daily survivors from Day A onward.

$S_{(A-1)}$: Number of survivors at the end of Day (A-1).
Example: for 3LE21, $S_{(A-1)}$=number of survivors on Day 5.

NT: Number of "no-takes" according to the criteria given in Protocols 7.300 and 11.103.

B. T/C Computed for all Treated Groups

T/C is the ratio (expressed as a percent) of the mean survival time of the treated group divided by the mean survival time of the control group. Treated group animals surviving beyond Day B, according to the chart below, are eliminated from calculations:

| No. of survivors in treated group beyond Day B | Percent of "no-takes" in control group | Conclusion |
|---|---|---|
| 1 | Any percent | "no-take" |
| 2 | <10 | drug inhibition |
|  | ≧10 | "no-takes" |
| ≧3 | <15 | drug inhibitions |
|  | ≧15 | "no-takes" |

Positive control compounds are not considered to have "no-takes" regardless of the number of "no-takes" in the control group. Thus, all survivors on Day B are used in the calculation of T/C for the positive control. Surviving animals are evaluated and recorded on the day of evaluation as "cures"or "no-takes."

Calculation of Median Survival Time

Median Survival Time is defined as the median day of death for a test or control group. If deaths are arranged in chronological order of occurrence (assigning to survivors, on the final day of observation, a "day of death" equal to that day), the median day of death is a day selected so that one half of the animals died earlier and the other half died later or survived. If the total number of animals is odd, the median day of death is the day that the middle animal in the chronological arrangement died. If the total number of animals is even, the median is the arithmetical mean of the two middle values. Median survival time is computed on the basis of the entire population and there are no deletion of early deaths or survivors, with the following exception:

C. Computation of Median Survival Time from Survivors

If the total number of animals including survivors (N) is even, the median survival time (days) (X+Y)/2, where X is the earlier day when the number of survivors is N/2, and Y is the earliest day when the number of survivors (N/2)−1. If N is odd, the median survival time (days) is X.

D. Computation of Median Survival Time from Mortality Distribution

If the total number of animals including survivors (N) is even, the median survival time (days) (X+Y)/2, where X is the earliest day when the cumulative number of deaths is N/2, and Y is the earliest day when the cumulative number of deaths is (N/2)+1. If N is odd, the median survival time (days) is X.

Cures and "No-Takes": "Cures" and "no-takes" in systems evaluated by median survival time are based upon the day of evaluation. On the day of evaluation any survivor not considered a "no-take" is recorded as a "cure." Survivors on day of evaluation are recorded as "cures" or "no-takes," but not eliminated from the calculation of the median survival time.

E. Calculation of Approximate Tumor Weight from Measurement of Tumor Diameters with Vernier Calipers The use of diameter measurements (with Vernier calipers) for estimating treatment effectiveness on local tumor size permits retention of the animals for lifespan observations. When the tumor is implanted sc, tumor weight is estimated from tumor diameter measurements as follows. The resultant local tumor is considered a prolate ellipsoid with one long axis and two short axes. The two short axes are assumed to be equal. The longest diameter (length) and the shortest diameter (width) are measured with Vernier calipers. Assuming specific gravity is approximately 1.0, and Pi is about 3, the mass (in mg) is calculated by multiplying the length of the tumor by the width squared and dividing the product by two. Thus, $$\text{Tumor weight(mg)} = \frac{\text{length(mm)} \times (\text{width[mm]})^2}{2} \text{ Or } \frac{L \times (W)^2}{2}$$

The reporting of tumor weights calculated in this way is acceptable inasmuch as the assumptions result in as much accuracy as the experimental method warrants.

F. Calculation of Tumor Diameters

The effects of a drug on the local tumor diameter may be reported directly as tumor diameters without conversion to tumor weight. To assess tumor inhibition by comparing the tumor diameters of treated animals with the tumor diameters of control animals, the three diameters of a tumor are averaged (the long axis and the two short axes). A tumor diameter T/C of 75% or less indicates activity and a T/C of 75% is approximately equivalent to a tumor weight T/C of 42%.

G. Calculation of Mean Tumor Weight from Individual Excised Tumors

The mean tumor weight is defined as the sum of the weights of individual excised tumors divided by the number of tumors. This calculation is modified according to the rules listed below regarding "no-takes." Small tumors weighing 39 mg or less in control mice or 99 mg or less in control rats, are regarded as "no-takes" and eliminated from the computations. In treated groups, such tumors are defined as "no-takes" or as true drug inhibitions according to the following rules:

| Percent of small tumors in treated group | Percent of "no-takes" in control group | Action |
|---|---|---|
| ≦17 | Any percent | no-take; not used in calculations |
| 18-39 | <10 | drug inhibition; use in calculations |
|  | ≧10 | no-takes; not used in calculations |
| ≧40 | <15 | drug inhibition; use in calculations |
|  | ≧15 | Code all nontoxic tests "33" |

Positive control compounds are not considered to have "no-takes" regardless of the number of "no-takes" in the control group. Thus, the tumor weights of all surviving animals are used in the calculation of T/C for the positive control. T/C are computed for all treated groups having more than 65% survivors. The T/C is the ratio (expressed as a percent) of the mean tumor weight for treated animals divided by the mean tumor weight for control animals. SDs of the mean control tumor weight are computed the factors in a table designed to estimate SD using the estimating factor for SD given the range (difference between highest and lowest observation). *Biometrik Tables for Statisticians* (Pearson E S, and Hartley H G, eds.) Cambridge Press, vol. 1, table 22, p. 165.

II. Specific Tumor Models

A. Lymphoid Leukemia L1210

Summary: Ascitic fluid from donor mouse is transferred into recipient $BDF_1$ or $CDF_1$ mice. Treatment begins 24 hours after implant. Results are expressed as a percentage of control survival time. Under normal conditions, the inoculum site for primary screening is i.p., the composition being tested is administered i.p., and the parameter is mean survival time. Origin of tumor line: induced in 1948 in spleen and lymph nodes of mice by painting skin with MCA. *J Natl Cancer Inst.* 13:1328 (1953).

Animals

Propagation: DBA/2 mice (or $BDF_1$ or $CDF_1$ for one generation).

Testing: $BDF_1$ (C57BL/6×DBA/2) or $CDF_1$ (BALB/c×DBA/2) mice.

Weight: Within a 3-g weight range, with a minimum weight of 18 g for males and 17 g for females.

Sex: One sex used for all test and control animals in one experiment.

Experiment Size Six animals per test group.

Control Groups Number of animals varies according to number of test groups.

Tumor Transfer

Inject i.p., 0.1 ml of diluted ascitic fluid containing $10^5$ cells.

Time of Transfer for Propagation: Day 6 or 7.

Time of Transfer for Testing: Day 6 or 7.

Testing Schedule

Day 0: Implant tumor. Prepare materials. Run positive control in every odd-numbered experiment. Record survivors daily.

Day 1: Weigh and randomize animals. Begin treatment with therapeutic composition. Typically, mice receive 1 ug of the test composition in 0.5 ml saline. Controls receive saline alone. The treatment is given as one dose per week. Any surviving mice are sacrificed after 4 weeks of therapy.

Day 5: Weigh animals and record.

Day 20: If there are no survivors except those treated with positive control compound, evaluate study.

Day 30: Kill all survivors and evaluate experiment.

Quality Control

Acceptable control survival time is 8-10 days. Positive control compound is 5-fluorouracil; single dose is 200 mg/kg/injection, intermittent dose is 60 mg/kg/injection, and chronic dose is 20 mg/kg/injection. Ratio of tumor to control (T/C) lower limit for positive control compound is 135%

Evaluation

Compute mean animal weight on Days 1 and 5, and at the completion of testing compute T/C for all test groups with >65% survivors on Day 5. A T/C value 85% indicates a toxic test. An initial T/C 125% is considered necessary to demonstrate activity. A reproduced T/C 125% is considered worthy of further study. For confirmed activity a composition should have two multi-dose assays that produce a T/C 25%.

B. Lymphocytic Leukemia P388

Summary: Ascitic fluid from donor mouse is implanted in recipient $BDF_1$ or $CDF_1$ mice. Treatment begins 24 hours after implant. Results are expressed as a percentage of control survival time. Under normal conditions, the inoculum site for primary screening is ip, the composition being tested is administered ip daily for 9 days, and the parameter is median survival time. Origin of tumor line: induced in 1955 in a DBA/2 mouse by painting with MCA. *Scientific Proceedings, Pathologists and Bacteriologists* 33:603, 1957.

Animals

Propagation: DBA/2 mice (or $BDF_1$ or $CDF_1$ for one generation)

Testing: $BDF_1$ (C57BL/6×DBA/2) or $CDF_1$ (BALB/c×DBA/2) mice.

Weight: Within a 3-g weight range, with a minimum weight of 18 g for males and 17 g for females.

Sex: One sex used for all test and control animals in one experiment.

Experiment Size Six animals per test group.

Control Groups Number of animals varies according to number of test groups.

Tumor Transfer

Implant: Inject ip

Size of Implant: 0.1 ml diluted ascitic fluid containing $10^6$ cells.

Time of Transfer for Propagation: Day 7.

Time of Transfer for Testing: Day 6 or 7.

Testing Schedule

Day 0: Implant tumor. Prepare materials. Run positive control in every odd-numbered experiment. Record survivors daily.

Day 1: Weigh and randomize animals. Begin treatment with therapeutic composition. Typically, mice receive 1 ug of the composition being tested in 0.5 ml saline. Controls receive saline alone. The treatment is given as one dose per week. Any surviving mice are sacrificed after 4 weeks of therapy.

Day 5: Weigh animals and record.

Day 20: If there are no survivors except those treated with positive control compound, evaluate experiment.

Day 30: Kill all survivors and evaluate experiment.

Quality Control

Acceptable median survival time is 9-14 days. Positive control compound is 5-fluorouracil: single dose is 200 mg/kg/injection, intermittent dose is 60 mg/kg/injection, and chronic dose is 20 mg/kg/injection. T/C lower limit for positive control compound is 135% Check control deaths, no takes, etc.

Evaluation

Compute mean animal weight on Days 1 and 5, and at the completion of testing compute T/C for all test groups with >65% survivors on Day 5. A T/C value 85% indicates a toxic test. An initial T/C 125% is considered necessary to demonstrate activity. A reproduced T/C 125% is considered worthy of further study. For confirmed activity a synthetic must have two multi-dose assays (each performed at a different laboratory) that produce a T/C 125%; a natural product must have two different samples that produce a T/C 125% in multi-dose assays.

C. Melanotic Melanoma B16

Summary: Tumor homogenate is implanted ip or sc in $BDF_1$ mice. Treatment begins 24 hours after either ip or sc implant or is delayed until an sc tumor of specified size (usually approximately 400 mg) can be palpated. Results expressed as a percentage of control survival time. The composition being tested is administered ip, and the parameter is mean survival time. Origin of tumor line: arose spontaneously in 1954 on the skin at the base of the ear in a C57BL/6 mouse. *Handbook on Genetically Standardized Jax Mice*. Roscoe B. Jackson Memorial Laboratory, Bar Harbor, Me., 1962. See also *Ann NY Acad Sci* 100, *Parts* 1 *and* 2, 1963.

Animals

Propagation: C57BL/6 mice.

Testing: $BDF_1$ (C57BL/6×DBA/2) mice.

Weight: Within a 3-g weight range, with a minimum weight of 18 g for males and 17 g for females.

Sex: One sex used for all test and control animals in one experiment.

Experiment Size Ten animals per test group. For control groups, the number of animals varies according to number of test groups.

Tumor Transfer

Propagation: Implant fragment sc by trochar or 12-gauge needle or tumor homogenate (see below) every 10-14 days into axillary region with puncture in inguinal region.

Testing: Excise sc tumor on Day 10-14.

Homogenate: Mix 1 g or tumor with 10 ml of cold balanced salt solution and homogenize, and implant 0.5 ml of this tumor homogenate ip or sc.

Fragment: A 25-mg fragment may be implanted sc.

Testing Schedule

Day 0: Implant tumor. Prepare materials. Run positive control in every odd-numbered experiment. Record survivors daily.

Day 1: Weigh and randomize animals. Begin treatment with therapeutic composition. Typically, mice receive 1 µg of the composition being tested in 0.5 ml saline. Controls receive saline alone. The treatment is given as one dose per week. Any surviving mice are sacrificed 8 weeks of therapy.

Day 5: Weigh animals and record.

Day 60: Kill all survivors and evaluate experiment.

Quality Control

Acceptable control survival time is 14-22 days. Positive control compound is 5-fluorouracil: single dose is 200 mg/kg/injection, intermittent dose is 60 mg/kg/injection, and chronic dose is 20 mg/kg/injection. T/C lower limit for positive control compound is 135% Check control deaths, no takes, etc.

Evaluation

Compute mean animal weight on Days 1 and 5, and at the completion of testing compute T/C for all test groups with >65% survivors on Day 5. A T/C value 85% indicates a toxic test. An initial T/C 125% is considered necessary to demonstrate activity. A reproduced T/C 125% is considered worthy of further study. For confirmed activity a therapeutic composition should have two multi-dose assays that produce a T/C 125%.

Metastasis after IV Injection of Tumor Cells $10^5$ B16 melanoma cells in 0.3 ml saline are injected intravenously in C57BL/6 mice. The mice are treated intravenously with 1 g of the composition being tested in 0.5 ml saline. Controls receive saline alone. The treatment is given as one dose per week. Mice sacrificed after 4 weeks of therapy, the lungs are removed and metastases are enumerated.

C. 3LL Lewis Lung Carcinoma

Summary: Tumor may be implanted sc as a 2-4 mm fragment, or im as a $2\times10^6$-cell inoculum. Treatment begins 24 hours after implant or is delayed until a tumor of specified size (usually approximately 400 mg) can be palpated. The composition being tested is administered ip daily for 11 days and the results are expressed as a percentage of the control.

Origin of tumor line: arose spontaneously in 1951 as carcinoma of the lung in a C57BL/6 mouse. Cancer Res 15:39, 1955. See, also Malave, I. et al., *J. Nat'l. Canc. Inst.* 62:83-88 (1979).

Animals

Propagation: C57BL/6 mice.

Testing: $BDF_1$ mice or C3H.

Weight: Within a 3-g weight range, with a minimum weight of 18 g for males and 17 g for females.

Sex: One sex used for all test and control animals in one experiment.

Experiment Size Six animals per test group for sc implant, or ten for im implant. For control groups, the number of animals varies according to number of test groups.

Tumor Transfer

Implant: Inject cells im in hind leg or implant fragment sc in axillary region with puncture in inguinal region.

Time of Transfer for Propagation: Days 12-14.

Time of Transfer for Testing: Days 12-14.

Testing Schedule

Day 0: Implant tumor. Prepare materials. Run positive control in every odd-numbered experiment. Record survivors daily.

Day 1: Weigh and randomize animals. Begin treatment with therapeutic composition. Typically, mice receive 1 ug of the composition being tested in 0.5 ml saline. Controls receive saline alone. The treatment is given as one dose per week. Any surviving mice are sacrificed after 4 weeks of therapy.

Day 5: Weigh animals and record.

Final Day: Kill all survivors and evaluate experiment.

Quality Control

Acceptable im tumor weight on Day 12 is 500-2500 mg. Acceptable im tumor median survival time is 18-28 days. Positive control compound is cyclophosphamide: 20 mg/kg/injection, qd, Days 1-11. Check control deaths, no takes, etc.

Evaluation

Compute mean animal weight when appropriate, and at the completion of testing compute T/C for all test groups. When the parameter is tumor weight, a reproducible T/C 42% is considered necessary to demonstrate activity. When the parameter is survival time, a reproducible T/C 125% is considered necessary to demonstrate activity. For confirmed activity a synthetic must have two multi-dose assays (each performed at a different laboratory); a natural product must have two different samples.

D. 3LL Lewis Lung Carcinoma Metastasis Model

This model has been utilized by a number of investigators. See, for example, Gorelik, E. et al., *J. Nat'l. Canc. Inst.* 65:1257-1264 (1980); Gorelik, E. et al., *Rec. Results Canc. Res.* 75:20-28 (1980); Isakov, N. et al., *Invasion Metas.* 2:12-32 (1982) Talmadge J. E. et al., *J. Nat'l. Canc. Inst.* 69:975-980 (1982); Hilgard, P. et al., *Br. J. Cancer* 35:78-86 (1977)).

Mice: male C57BL/6 mice, 2-3 months old.

Tumor: The 3LL Lewis Lung Carcinoma was maintained by sc transfers in C57BL/6 mice. Following sc, im or intra-footpad transplantation, this tumor produces metastases, preferentially in the lungs. Single-cell suspensions are prepared from solid tumors by treating minced tumor tissue with a solution of 0.3% trypsin. Cells are washed 3 times with PBS (pH 7.4) and suspended in PBS. Viability of the 3LL cells prepared in this way is generally about 95-99% (by trypan blue dye exclusion). Viable tumor cells ($3\times10^4$-$5\times10^6$) suspended in 0.05 ml PBS are injected into the right hind foot pads of C57BL/6 mice. The day of tumor appearance and the diameters of established tumors are measured by caliper every two days.

Typically, mice receive 1 ug of the composition being tested in 0.5 ml saline. Controls receive saline alone. The treatment is given as one or two doses per week. In experiments involving tumor excision, mice with tumors 8-10 mm in diameter are divided into two groups. In one group, legs with tumors are amputated after ligation above the knee joints. Mice in the second group are left intact as nonamputated tumor-bearing controls. Amputation of a tumor-free leg in a tumor-bearing mouse has no known effect on subsequent metastasis, ruling out possible effects of anesthesia, stress or surgery. Surgery is performed under Nembutal anesthesia (60 mg veterinary Nembutal per kg body weight).

Determination of Metastasis Spread and Growth

Mice are killed 10-14 days after amputation. Lungs are removed and weighed. Lungs are fixed in Bouin's solution and the number of visible metastases is recorded. The diameters of the metastases are also measured using a binocular stereoscope equipped with a micrometer-containing ocular under 8× magnification. On the basis of the recorded diameters, it is possible to calculate the volume of each metastasis. To determine the total volume of metastases per lung, the mean number of visible metastases is multiplied by the mean volume of metastases. To further determine metastatic growth, it is possible to measure incorporation of $^{125}$IdUrd into lung cells (Thakur, M. L. et al., *J. Lab. Clin. Med.* 89:217-228 (1977). Ten days following tumor amputation, 25 μg of FdUrd is inoculated into the peritoneums of tumor-bearing (and, if used, tumor-resected mice. After 30 min, mice are given 1 μCi of $^{125}$IdUrd. One day later, lungs and spleens are removed and weighed, and a degree of $^{125}$IdUrd incorporation is measured using a gamma counter.

Statistics: Values representing the incidence of metastases and their growth in the lungs of tumor-bearing mice are not normally distributed. Therefore, non-parametric statistics such as the Mann-Whitney U-Test may be used for analysis.

Study of this model by Gorelik et al. (1980, supra) showed that the size of the tumor cell inoculum determined the extent of metastatic growth. The rate of metastasis in the lungs of operated mice was different from primary tumor-bearing mice. Thus in the lungs of mice in which the primary tumor had been induced by inoculation of large doses of 3LL cells ($1-5 \times 10^6$) followed by surgical removal, the number of metastases was lower than that in nonoperated tumor-bearing mice, though the volume of metastases was higher than in the nonoperated controls. Using $^{125}$IdUrd incorporation as a measure of lung metastasis, no significant differences were found between the lungs of tumor-excised mice and tumor-bearing mice originally inoculated with $1 \times 10^6$ 3LL cells. Amputation of tumors produced following inoculation of $1 \times 10^5$ tumor cells dramatically accelerated metastatic growth. These results were in accord with the survival of mice after excision of local tumors. The phenomenon of acceleration of metastatic growth following excision of local tumors had been observed by other investigators. The growth rate and incidence of pulmonary metastasis were highest in mice inoculated with the lowest doses ($3 \times 10^4$-$1 \times 10^5$ of tumor cells) and characterized also by the longest latency periods before local tumor appearance. Immunosuppression accelerated metastatic growth, though nonimmunologic mechanisms participate in the control exerted by the local tumor on lung metastasis development. These observations have implications for the prognosis of patients who undergo cancer surgery.

E. Walker Carcinosarcoma 256

Summary: Tumor may be implanted sc in the axillary region as a 2-6 mm fragment, im in the thigh as a 0.2-ml inoculum of tumor homogenate containing $10^6$ viable cells, or ip as a 0.1-ml suspension containing $10^6$ viable cells. Treatment of the composition being tested is usually ip. Origin of tumor line: arose spontaneously in 1928 in the region of the mammary gland of a pregnant albino rat. *J Natl Cancer Inst* 13:1356, 1953.

Animals

Propagation: Random-bred albino Sprague-Dawley rats.

Testing: Fischer 344 rats or random-bred albino rats.

Weight Range: 50-70 g (maximum of 10-g weight range within each experiment).

Sex: One sex used for all test and control animals in one experiment.

Experiment Size Six animals per test group. For control groups, the number of animals varies according to number of test groups.

Time of Tumor Transfer

Time of Transfer for Propagation: Day 7 for im or ip implant; Days 11-13 for sc implant. Time of Transfer for Testing: Day 7 for im or ip implant; Days 11-13 for sc implant.

Tumor Transfer

Sc fragment implant is by trochar or 12-gauge needle into axillary region with puncture in inguinal area. Im implant is with 0.2 ml of tumor homogenate (containing $10^6$ viable cells) into the thigh. Ip implant is with 0.1 ml of suspension (containing $10^6$ viable cells) into the ip cavity.

Testing Schedule

Prepare and administer compositions under test on days, weigh animals, and evaluate test on the days listed in the following tables.

| Test system | Prepare drug | Administer drug | Weight animals | Evaluate |
|---|---|---|---|---|
| 5WA16 | 2 | 3-6 | 3 and 7 | 7 |
| 5WA12 | 0 | 1-5 | 1 and 5 | 10-14 |
| 5WA31 | 0 | 1-9 | 1 and 5 | 30 |

Day 0: Implant tumor. Prepare materials. Run positive control in every odd-numbered experiment. Record survivors daily.

Day 1: Weigh and randomize animals.

Final Day: Kill all survivors and evaluate experiment.

Quality Control

Acceptable im tumor weight or survival time for the above three test systems:

5WA16: 3-12 g. 5WA12: 3-12 g. 5WA31 or 5WA21: 5-9 days.

Evaluation

Compute mean animal weight when appropriate, and at the completion of testing compute T/C for all test groups. When the parameter is tumor weight, a reproducible T/C 42% is considered necessary to demonstrate activity. When the parameter is survival time, a reproducible T/C 125% is considered necessary to demonstrate activity. For confirmed activity a therapeutic agent must have activity in two multi-dose assays.

F. A20 lymphoma $10^6$ murine A20 lymphoma cells in 0.3 ml saline are injected subcutaneously in Balb/c mice. The mice are treated intravenously with 1 g of the composition being tested in 0.5 ml saline. Controls receive saline alone. The treatment is given as one dose per week. Tumor growth is monitored daily by physical measurement of tumor size and calculation of total tumor volume. After 4 weeks of therapy the mice are sacrificed.

Use in Established Tumors

For proteins or nucleic acid constructs, treatment consists of injecting animals iv or ip with 50, 500 1000 or 5,000 ng of in 0.1-0.5 ml of normal saline. Unless indicated otherwise above, treatments are given one to three times per week for two to five weeks. Phage displays are administered as 10 transducing units (TU) and irradiated bacterial cells as $10^5$ cells iv into the tail vein one to three times per week for two to five weeks. Exosomes or vesicles, harvested from transfected, transformed or fusion tumor cells or sickled cells are given i.v. into the tail vein in a dose of 0.25-1 g per animal one to three times per week for two to five weeks. The results shown in Table VI are for each composition and dose tested. The results are statistically significant by the Wilcoxon rank sum test.

TABLE VI

| Tumor Model | Parameter | % of Control Response |
|---|---|---|
| L1210 | Mean survival time | >130% |
| P388 | Mean survival time | >130% |
| B16 | Mean survival time | >130% |
| B16 metastasis | Median number of metastases | <70% |
| 3LL | Mean survival time | >130% |
| | Mean tumor weight | <40% |
| 3LL metastasis | Median survival time | >130% |
| | Mean lung weight | <60 |
| | Median number of metastases | <60% |
| | Median volume of metastases | <60% |
| | Medial volume of metastases | <60% |
| | Median uptake of IdUrd | <60% |
| Walker carcinoma | Median survival time | >130% |
| | Mean tumor weight | <40% |
| A20 | Mean survival time | >130% |
| | Mean tumor volume | <40% |

Antitumor Effects of Therapeutic Constructs and Effector T, NKT Cells or Sickled Erythrocytes in Human Patients All patients treated have histologically confirmed malignant disease including carcinomas, sarcomas, melanomas, lymphomas and leukemia and have failed conventional therapy. Patients may be diagnosed as having any stage of metastatic disease involving any organ system. Staging describes both tumor and host, including organ of origin of the tumor, histologic type and histologic grade, extent of tumor size, site of metastases and functional status of the patient. A general classification includes the known ranges of Stage I (localized disease) to Stage 4 (widespread metastases). Patient history is obtained and physical examination performed along with conventional tests of cardiovascular and pulmonary function and appropriate radiologic procedures. Histopathology is obtained to verify malignant disease.

Example 7

Treatment Procedures

Constructs (or Preparations)

Doses of the constructs are determined as described above using, inter alia, appropriate animal models of tumors. Treatments are given 3x/week for a total of 12 treatments. Patients with stable or regressing disease are treated beyond the $12^{th}$ treatment. Treatment is given on either an outpatient or inpatient basis as needed.

Patient Evaluation

Assessment of response of the tumor to the therapy is made once per week during therapy and 30 days thereafter. Depending on the response to treatment, side effects, and the health status of the patient, treatment is terminated or prolonged from the standard protocol given above. Tumor response criteria are those established by the International Union Against Cancer and are listed in Table VII.

TABLE VII

| RESPONSE | DEFINITION |
|---|---|
| Complete remission (CR) | Disappearance of all evidence of disease |
| Partial remission (PR) | >50% decrease in the product of the two greatest perpendicular tumor diameters; no new lesions |
| Less than partial remission (<PR) | 25-50% decrease in tumor size, stable for at least 1 month |
| Stable disease | <25% reduction in tumor size; no progression or new lesions |
| Progression | >25% increase in size of any one measured lesion or appearance of new lesions despite stabilization or remission of disease in other measured sites |

The efficacy of the therapy in a population is evaluated using conventional statistical methods including, for example, the Chi Square test or Fisher's exact test. Long-term changes in and short term changes in measurements can be evaluated separately.

Results

One hundred and fifty patients are treated. The results are summarized in Table VIII. Positive tumor responses are observed in 80% of the patients as follows:

TABLE VIII

| All Patients | | |
|---|---|---|
| Response | No. | % |
| PR | 20 | 66% |
| <PR | 10 | 33% |
| Tumor Types | Response | % of Patients |
| Breast Adenocarcinoma | PR + <PR | 80% |
| Gastrointestinal Carcinoma | PR + <PR | 75% |
| Lung Carcinoma | PR + <PR | 75% |
| Prostate Carcinoma | PR + <PR | 75% |
| Lymphoma/Leukemia | PR + <PR | 75% |
| Head and Neck Cancer | PR + <PR | 75% |
| Renal and Bladder Cancer | PR + <PR | 75% |
| Melanoma | PR + <PR | 75% |

ADDITIONAL DOCUMENTS INCORPORATED BY REFERENCE

This application incorporates by reference the following patents and currently pending patent applications that disclose inventions of the present inventor alone or with co-inventors.

1. Patent application WO91/US342, "Tumor Killing Effects of Enterotoxins and Related Compounds" filed 17 Jan. 1991, and published as WO 91/10680 on 25 Jul. 1991.
2. U.S. Ser. No. 07/891,718 "Tumor Killing Effects of Enterotoxins and Related Compounds," filed 1 Jun. 1992.
3. U.S. Pat. No. 5,728,388, "Method of Cancer Treatment," issued Mar. 17, 1998.
4. U.S. Ser. No. 08/491,746, "Method of Cancer Treatment," filed 19 Jun. 1995.
5. U.S. Ser. No. 08/898,903 "Method of Cancer Treatment," filed 23 Jul. 1997.

6. U.S. Ser. No. 08/896,933 "Tumor Killing Effects of Enterotoxins and Related Compounds," filed 18 Jul. 1997.
7. U.S. Ser. No. 60/085,506, "Compositions and Methods for Treatment of Cancer," filed 5 May 1998.
8. U.S. Ser. No. 60/094,952 "Compositions and Methods for Treatment of Cancer" filed 31 Jul. 1998.
9. U.S. Ser. No. 60/033,172 "Superantigen-Based Methods and Compositions for Treatment of Cancer," filed 17 Dec. 1996.
10. U.S. Ser. No. 60/044,074 "Superantigen-Based Methods and Compositions for Treatment of Cancer," filed 17 Apr. 1997.
11. U.S. Ser. No. 09/061,334 "Tumor Cells with Increased Immunogenicity and Uses Thereof," filed 17 Apr. 1998.

Moreover, all references cited herein are incorporated by reference, whether specifically incorporated or not.

Having now fully described this invention, it will be appreciated by those skilled in the art that the same can be performed within a wide range of equivalent parameters, concentrations, and conditions without departing from the spirit and scope of the invention and without undue experimentation.

While this invention has been described in connection with specific embodiments thereof, it will be understood that it is capable of further modifications. This application is intended to cover any variations, uses, or adaptations of the invention following, in general, the principles of the invention and including such departures from the present disclosure as come within known or customary practice within the art to which the invention pertains and as may be applied to the essential features hereinbefore set forth as follows in the scope of the appended claims.

---

SEQUENCE LISTING (92 sequences)

SEQ ID NO: 1 - DNA, 279 bp, Homo sapiens
  CDS (1)..(279)
gtgaagcccaaggcctggctgtcccgtggccccagtcctggccctggccgtctgctgctggtgtgccatgtctcaggattctacccaaagcctgtatgggtgaagtggatgcggggtgagcaggagcagcagggcactcagccaggggacatcctgcccaatgctgacgagacatggtatctccgagcaaccctggatgtggtggctggggaggcagctggcctgtcctgtcgggtgaagcacagcagtctagagggccaggacatcgtcctctactgg

SEQ ID NO: 2 - protein, 93 aa, Homo sapiens
VKPKAWLSRGPSPGPGRLLLVCHVSGFYPKPVWVKWMRGEQEQQGTQPGDILPNADETWYLRATLDVVAGEAAGLSCRVKHSSLEGQDIVLYW

SEQ ID NO: 3 - DNA, 1443 bp, Staphylococcus aureus
  CDS (262)..(1032)
ccaaaataatggcaagtactccgttgtcaataccaagtaagtaagatatctgaaatgtataatagagtaaaaatgaaatctttttattatattatagacaagtataaaaaaggtatagtaatatatgtatgtataagtaaataatgataattctataattattgtatataactaataattacttcgacaaaaataatctattatccaaatattttagataataaaaagtttgtatggaattatgctttagaggtgagcaaaatgaaaaaaacagcatttatactacttttattcattgccctaacgtggacaacaagtccacttgtaaatggtagcgagaaaagcgaagaaataaatgaaaaagatttgcgaaaaaagtctgaattgcagggagcagctttaggcaatcttaaacaaatctattattacaatgaaaaagctaaaactgaaaataaagagagtcacgatcaatttttacagcatactatattgtttaaaggcttttttacaaatcattcatggtataacgatttattagtagattttgattcaaaggatattgttgataaatataaagggaaaaaagtagacttatatggtgcttattatggttatcaatgtgcgggtggtacaccaaacaaaacagcttgcatgtatggtggtgtaacgttacatgataataatcgattgaccgaagagaaaaaagtgccgatcaatttatggctagacggtaaacaaaatacagtacctttggaaacggttaaaacgaataagaaaaatgtaactgttcaggagttggatcttcaagcaagacgttatttacaggaaaaatataatttatataactctgatgtttttgatgggaaggttcagaggggattaatcgtgtttcatacttctacagaaccttcggttaattacgatttatttggtgctcaaggacagaattcaaatacactattaagaatatatagagataataaaacgattaactctgaaaacatgcatattgatatatatttatatacaagttaaacatggtagttttgaacacgtaatgttcagattattatgaaccgagaataatctgaaagtttacaagcagtaaaaaaagtatatgtgctataatatgctttgagcaagttggatagatggtggctatctgagtataaggaggtggtgcctatggtggcattactgaaatctttagaaaggagacgcctaatgattacaattagtaccaatgttgcagtttggtttattccttattgcattgataggtctagtaatcaagcttattgaattaagcaataaaaaataaccatcgctaactttggctggtttcgatggttaaatggttattaatttaatctttaatctaaaatagccaccgtctttttaacgggctcattagggtaacatgtttgcgcatgttgccctttt

SEQ ID NO: 4 - protein, 257 aa, Staphylococcus aureus
MKKTAFILLLFIALTWTTSPLVNGSEKSEEINEKDLRKKSELQGAALGNLKQIYYYNEKAKTENKESHDQFLQHTILFKGFFTNHSWYNDLLVDFDSKDIVDKYKGKKVDLYGAYYGYQCAGGTPNKTACMYGGVTLHDNNRLTEEKKVPINLWLDGKQNTVPLETVKTNKKNVTVQELDLQARRYLQEKYNLYNSDVFDGKVQRGLIVFHTSTEPSVNYDLFGAQGQNSNTLLRIYRDNKTINSENMHIDIYLYTS

SEQ ID NO: 5 - DNA, 1712 bp, Staphylococcus aureus
  CDS (244)..(1044)
gaactaggtagaaaaataattatgagaaaacactatgttgttaaagatgttttcgtatataagtttaggtgatgtatagttacttaattttaaaagcataacttaattaatataaataacatgagattattaaatataattaagtttcttttaatgtttttttaattgaatatttaagattataacatatatttaaagtgtatctagatactttttgggaatgttggataaaggagataaaaaatgtataagagattatttatttcacatgtaattttgatattcgcactgatattagttatttctacacccaacgttttagcagagagtcaaccagatcctaaaccagatgagttgcacaaatcgagtaaattcactggtttgatggaaaatatgaaagttttgtatgatgataatcatgtatcagcaataaacgttaaatctatagatcaatttctatactttgacttaatatattctattaaggacactaagttagggaattatgataatgttcgagtcgaatttaaaaacaaagatttagctgataaatacaaagataaatacgtagatgtgtttggagctaattattattatcaatgttatttttctaaaaaaacgaatgatattaattcgcatcaaactgacaaacgaaaaacttgtatgtatggtggtgtaactgagcataatggaaaccaattagataaatatagaagtattactgttcgggtatttgaagatggtaaaaatttattatcttttgacgtacaaactaataagaaaaaggtgactgctcaagaattagattacctaactcgtcactatttggtgaaaaataaaaaactctatgaatttaacaactcgccttatgaaacgggatatattaaatttatagaaaatgagaatagcttttggtatgacatgatgcctgcaccaggagataaatttgaccaatctaaatatttaatgatgtacaatgacaataaaatggttgattctaaagatgtgaagattgaagtttatcttacgacaaagaaaaagtgaaattatattttagaaaagtaaatatgaagagttagtaattaaggcaggcacttatagagtacctgccttttctaatattatttagttatagttatttttgttatatctctctgatttagcattaaccccttgttgccattatagttttcaccaactttagctgaaattgggggatcatttttatctttactatggatagttactgtgtcgccgtttttaacgatttgtttctcttttaatttgtcagttaattttttccatgcatcatttgcgtcaaacctatttccatttggatttattcttgacaaatcaattcttttaacactatcggtattaatcggcttgttattaaaattactaagttcatctaaatcagctgtacccgtaatactactttcgccaccattatttaaattgtacgtaacaccaactgtctcatttgctgttttatcgataatatttgcttctttcaaagcatctcttacatttttccataagtctctatctgttatttcagaagcctttgcaacgttattaataccattataatttgaagaagaatgaaaacctgaacctactgttgttaaaactaaagcacttgctatcaatgttcttgttaatagttttttattcattttattttctcctataacttatttgcaatcgat

SEQ ID NO: 6 - protein, 266 aa, Staphylococcus aureus
MYKRLFISHVILIFALILVISTPNVLAESQPDPKPDELHKSSKFTGLMENMKVLYDDNHVSAINVKSIDQFLYFDLIYSIKDTKLGNYDNVRVEFKNKDLADKYKDKYVDVFGANYYYQCYFSKKTNDINSHQTDKRKTCMYGGVTEHNGNQLDKYRSITVRVFEDGKNLLSFDVQTNKKKVTAQELDYLTRHYLVKNKKLYEFNNSPYETGYIKFIENENSFWYDMMPAPGDKFDQSKYLMMYNDNKMVDSKDVKIEVYLTTKKK

SEQ ID NO: 7 - DNA, 1095 bp, Staphylococcus aureus
  CDS (118)..(918)
atcattaaatataattaattttcttttaatatttttttaattgaatatttaagattataagatatatttaaagtgtatctagatactttttgggaatgttggatgaaggagataaaaatgaataagagtcgatttatttcatgcgtaattttgatattcgcacttatactagttctttttacacccaacgtattagcagagagccaaccagaccctacgccagatgagttgcacaaagcgagtaaattcactggtttgatggaaaatatgaaagttttatatgatgatcattatgtatcagcaactaaagttaagtctgtagataaatttttggcacatgatttaatttataacattagtgataaaaaactgaaaaattatgacaaagtgaaaacagagttattaaatgaaggtttagcaaagaagtacaaagatgaagtagttgatgtgtatggatcaaattactatgtaaactgctatttttcatccaaagataatgtaggtaaagttacaggtggcaaaacttgtatgtatggaggaataacaaaacatgaaggaaaccactttgataatgggaacttacaaaatgtacttataagagtttatgaaaataaaagaaacacaatttcttttgaagtgcaaactgataagaaaagtgtaacagctcaagaactagacataaaagctaggaattttttaattaataaaaaaaatttgtatgagtttaacagttcaccatatgaaacaggatatataaaatttattgaaaataacggcaatactttttggtatgatatgatgcctgcaccaggcgataagtttgaccaatctaaatatttaatgatgtacaacgacaataaaacggttgattctaaaagtgtgaagatagaagtccaccttacaacaaagaatggataatgttaatccgattttgatataaaaagtgaaagtattagatatatttgaaaggtaagtacttcggtgcttgcctttttaggatgcatatatatagattaaaccgcacttctatattaatagaaagtgcggttatttatacactcaatctaaactataataattggaatcatcttcaaa

SEQ ID NO: 8 - protein, 266 aa, Staphylococcus aureus
MNKSRFISCVILIFALILVLFTPNVLAESQPDPTPDELHKASKFTGLMENMKVLYDDHYVSATKVKSVDKFLAHDLIYNISDKKLKNYDKVKTELLNEGLAKKYKDEVVDVYGSNYYVNCYFSSKDNVGKVTGGKTCMYGGITKHEGNHFDNGNLQNVLIRVYENKRNTISFEVQTDKKSVTAQELDIKARNFLINKKNLYEFNSSPYETGYIKFIENNGNTFWYDMMPAPGDKFDQSKYLMMYNDNKTVDSKSVKIEVHLTTKNG

SEQ ID NO: 9 - DNA, 1136 bp, Staphylococcus aureus
  CDS (292)..(1068)
gatcaaatatattgatataatgaaagtgagcaagttggatagattgcggctagtctcttgaaaaaagggattcctatgtttatagttggtacttctaggaaggactagcatgtcttatttcgaaatgctgatggttgtattaacaattatgagtttagtcttaattagtaatcaaaactctgaatgtattgtctacataatcggtgtaacaataatatatatccgaaagattaaagtactctataaaagaatcatttaaaggtgctcaaatttattgaaaaaaggtggaatatgaaaaaatttaacattcttattgcattactcttttttactagtttggtaatatctcctttaaacgttaaagccaatgaaaacattgattcagtaaaagagaaagaattgcataaaaaatctgaattaagtagtaccgcgctaaataatatgaaacattcttatgcagataaaaatccaataataggagaaaataaaagtacaggagatcaatttttagaaaatactttgctttacaaaaaattttttactgaccttatcaattttgaagatttattaataaacttcaattcaaaagaaatggctcaacatttcaaatctaaaaatgtagatgtttaccctataagatatagcattaattgttatggtggtgaaatagataggactgcttgtacatatggaggtgtcactccacacgaaggtaataaattaaaagaacgaaaaaaaataccaatcaatttgtggataaatggtgtacaaaaagaagtttctttagataaagttcaaacagataaaaaaaatgttaccgtacaagaattagatgcacaagcaaggcgctatttgcaaaaggatttaaaattgtataataatgatactctcggaggaaaaatacagcgcggaaaaatagagtttgattcttctgatgggtctaaagtctcttatgatttatttgatgttaagggtgattttcccgaaaaacaattacgaatatacagtgataataaaacattatccacagagcaccttcatattgacatctatttatatgaaaagtagtcaattcaaatactttaacatcagacactaaagccatttcaaagaatgctaaagatttattaatcggt

SEQ ID NO: 10 - protein, 258 aa, Staphylococcus aureus
MKKFNILIALLFFTSLVISPLNVKANENIDSVKEKELHKKSELSSTALNNMKHSYADKNPIIGENKSTGDQFLENTLLYKKFFTDLINFEDLLINFNSKEMAQHFKSKNVDVYPIRYSINCYGGEIDRTACTYGGVTPHEGNKLKERKKIPINLWINGVQKEVSLDKVQTDKKNVTVQELDAQARRYLQKDLKLYNNDTLGGKIQRGKIEFDSSDGSKVSYDLFDVKGDFPEKQLRIYSDNKTLSTEHLHIDIYLYEK

SEQ ID NO: 11 - DNA, 774 bp, Staphylococcus aureus
  CDS (1)..(744)
atgaaaaaaacagcatttatactacttttattcattgccctaacgttgacaacaagtccacttgtaaatggtagcgagaaaagcgaagaaataaatgaaaaagatttgcgaaaaaagtctgaattacaaagaaatgctttaagcaatcttaggcaaatttattattataatgaaaaagctataactgaaaacaaagagagtgatgatcagtttttagagaatactttgttatttaaaggttttttcacaggtcatccatggtataacgatttattagtagatcttggttcaaaagatgctactaataaatataaagggaaaaaagtagacttatatggtgcttattatggatatcaatgtgctggaggcacaccaaataaaacagcatgtatgtacgggggtgtaacattacatgataataaccgattgaccgaagaaaaaaaagtaccaattaacttgtggatagacggaaaacaaactacagtacctatagataaagttaaaacaagcaaaaaagaagtaactgttcaagagctagatcttcaggcaaggcattatttacacggaaaatttggtttatataactcagacagctttggcggtaaggtgcaaagaggcttgattgtgtttcattcttctgaagggtccacggtaagttatgatttgtttgatgctcaagggcaatatccagatacattattaagaatttacagagataataaaactattaattcagagaacctccatattgatttgtatttatacacaacttga

SEQ ID NO: 12 - protein, 248 aa, Staphylococcus aureus
MKKTAFILLLFIALTLTTSPLVNGSEKSEEINEKDLRKKSELQRNALSNLRQIYYYNEKAITENKESDDQFLENTLLFKGFFTGHPWYNDLLVDLGSKDATNKYKGKKVDLYGAYYGYQCAGGTPNKTACMYGGVTLHDNNRLTEEKKVPINLWIDGKQTTVPIDKVKTSKKEVTVQELDLQARHYLHGKFGLYNSDSFGGKVQRGLIVFHSSEGSTVSYDLFDAQGQYPDTLLRIYRDNKTINSENL

SEQ ID NO: 13 - DNA, 1873 bp, Mus musculus
  CDS (173)..(175)
  CDS (273)..(314)
  CDS (315)..(1367)
aggaagggacagggtgacaccccaggattacataaatttacaggggctgccgaattggtcgaacaagcccgtggaacctggaagccagagaacaccatcgctgtaaaggaaagaaactgaagcttttctcggagcctatctgggctgctcaaactttcagaatctaccgaccatggtgagtcagacagactgtcttggggtggaactggagccaacctgaggaatctcagggtcctggcaggagtctccctgtccccctactttctcctcaggagcgtgtgcttggcttgttgctgttgcttctggtgcacgcctctcccgccccaccagagccctgcgagctagacgaggaaagttgctcctgcaacttctcagatccgaagccagattggtccagcgctttcaattgtttgggggcggcagatgtggaattgtacggcggcggccgcagcctggaataccttctaaagcgtgtggacacggaagcagatctggggcagttcactgatattatcaagtctctgtccttaaagcggcttacggtgcgggccgcgcggattcctagtcggattctattcggagccctgcgtgtgctcgggatttccggcctccaggaactgactcttgaaaatctcgaggtaaccggcaccgcgccgccaccgcttctggaagccaccggacccgatctcaacatcttgaacctccgcaacgtgtcgtgggcaacaagggatgcctggctcgcagaactgcagcagtggctaaagcctggactcaaggtactgagtattgcccaagcacactcactcaacttttcctgcgaacaggtccgcgtcttccctgccctctccaccttagacctgtctgacaatcctgaattgggcgagagaggactgatctcagccctctgtcccctcaagttcccgaccctccaagttttagcgctgcgtaacgcggggatggagacgcccagcggcgtgtgctctgcgctggccgcagcaagggtacagctgcaaggactagaccttagtcacaattcactgcgggatgctgcaggcgctccgagttgtgactggcccagtcagctaaactcgctcaatctgtctttcactgggctgaagcaggtacctaaagggctgccagccaagctcagcgtgctggatctcagttacaacaggctggataggaaccctagcccagatgagctgccccaagtggggaacctgtcacttaaaggaaatccctttttggactctgaatcccactcggagaagtttaactctggcgtagtcaccgccggagctccatcatcccaagcagtggccttgtcaggaactctggctttgctcctaggagatcgcctctttgtttaaggaacatttgcatcctcctggtttctgagggtcctcgtcaacgaatcctctgctttaaatttattaaaatcttaatccacgatgtaaggaaagaaaggcagtcaagatggttcagtgggtaaaagccagcaaacttgacccctgattttaaccctcaggatccacacggaaggggaaaactcactcctgaaagttgtccatctgtgctcacaaataaatattttttaaaataacaatgtgtttgttggttttgtttttgtttgggttttgttgtggttttgtttgttttgttttgtttttgagacagtctggctatgtatccttggctggcctcaaactcataaagatcaagatcggcctgcctctacctccaaatgctctggttaaagggatgtgcctccatgcccagttgaagtcatcctgaaccacgagtccaggccactcactctttactaagatctttactaagtatctgccataggtcaggctcagtgctaaatgag

SEQ ID NO: 14 - protein, 366 aa, Mus musculus
MERVLGLLLLLLVHASPAPPEPCELDEESCSCNFSDPKPDWSSAFNCLGAADVELYGGGRSLEYLLKRVDTEADLGQFTDIIKSLSLKRLTVRAARIPSRILFGALRVLGISGLQELTLENLEVTGTAPPPLLEATGPDLNILNLRNVSWATRDAWLAELQQWLKPGLKVLSIAQAHSLNFSCEQVRVFPALSTLDLSDNPELGERGLISALCPLKFPTLQVLALRNAGMETPSGVCSALAAARVQLQGLDLSHNSLRDAAGAPSCDWPSQLNSLNLSFTGLKQVPKGLPAKLSVLDLSYNRLDRNPSPDELPQVGNLSLKGNPFLDSESHSEKFNSGVVTAGAPSSQAVALSGTLALLLGDRLFV

SEQ ID NO: 15 - protein, 365 aa, Mus musculus
MDKFWWHTAWGLCLLQLSLAHPHQQIDLNVTCRYAGVFHVEKNGRYSISRTEAADLCQAFNSTLPTMDQMKLALSKGFETCRYGFIEGNVVIPRIHPNAICAANHTGVYILVTSNTSHYDTYCFNASAPPEEDCTSVTDLPNSFDGPVTITIVNRDGTRYSKKGEYRTHQEDIDASNIIDDDVSSGSTIEKSTPESYILHTYLPTEQPTGDQDDSFFIRSTLATRDRDSSKDSRGSSRTVTHGSELAGHSSANQDSGVTTTSGPMRRPQIPEWLIILASLLALALILAVCIAVNSRRRCGQKKKLVINGGNGTVEDRKPSELNGEASKSQEMVHLVNKEPSETPDQCMTADETRNLQSVDMKIGV

SEQ ID NO: 16 - protein, 371 aa, Mus musculus
MNVKGKVILLMLIVSTVVVVFWEYVNSPDGSFLWIYHTKIPEVGENRWQKDWWFPSWFKNGTHSYQEDNVEGRREKGRNGDRIEEPQLWDWFNPKNRPDVLTVTPWKAPIVWEGTYDTALLEKYYATQKLTVGLTVFAVGKYIEHYLEDFLESADMYFMVGHRVIFYVMIDDTSRMPVVHLNPLHSLQVFEIRSEKRWQDISMMRMKTIGEHILAHIQHEVDFLFCMDVDQVFQDNFGVETLGQLVAQLQAWWYKASPEKFTYERRELSAAYIPFGEGDFYYHAAIFGGTPTHILNLTRECFKGILQDKKHDIEAQWHDESHLNKYFLFNKPTKILSPEYCWDYQIGLPSDIKSVKVAWQTKEYNLVRNNV

SEQ ID NO: 17 - DNA, 79 bp, Homo sapiens
  CDS (3)..(77)
gcagtttaacgggggaggggactcagccccagcattttggtgatgggactcgactctccatcctagaggacctgaacaa

SEQ ID NO: 18 - protein, 25 aa, Homo sapiens
SLTGEGTQPQHFGDGTRLSILEDLN

SEQ ID NO: 19 - DNA, 1197 bp, Streptococcus pyogenes
  CDS (106)..(1119)
attggctctggagatggattataaagagattgcagatgccaaaggtgcaactatcacaggggcatggtcagacagtccacaaattatattagacggaggtaaaaaatgagtgaaaatataccgctgcgagtccaatttaagcgcatgaaagccgccgagtgggctcgtagtgatgtcatcttactggagagcgagataggctttgagacagacacaggttttgccagagcaggtgatgggcacaatcgatttagtgaccttggatacattagtccactcgattacaatctactgactaacaagccaaatattgatggattagcgacaaaagtcgagaccgctcagaaactacaacaaaaagcagataaagagaccgtctatacaaaagctgaatcgaagcaagagcttgacaagaaattaaatctcaaaggtggcgttatgacaggtcaactaaaatttaagccagccgccactgttgcttattcctcgtcaacgggtggagcggtcaatattgacttgtcgtctaccagaggtgctggtgttgttgtctattctgacaatgataccagtgatgggccgttaatgagcttgcggacgggtaaagagacctttaatcaatcggcgctttttgtcgactataaggggacaacaaatgccgttaatattgcgatgcgtcacgcaaccacccccaatttttcatcggcgcttaatattactagcggcaatgaaaatggtagtgcaatgcagctacgagggtcagaaaaagcgctaggaacgctaaaaattactcatgagaacccaagtattggagcggattatgataaaaatgcggcacgttatccattgatattgtcaaaaagacaaaacggtgcaggaacagccgctcagggaatctacattaactcaacctcaggcacgacagggaagttgcttaggattagaaaccttagtgatgataagttctacgtcaagtctgacggtggtttttatgccaaggaaacttcgcagattgatggcaacctgaaactcaaggaccccacagcgaatgatcatgcggcaaccaaagcttatgtagataaagcaatttctgagttaaaaaaactcatactaaaaaaatagattaaggaggataaatgagcagagacccaacacttattttagacgagtcaaacctcgttattggtaaggatggacgtg

SEQ ID NO: 20 - protein, 337 aa, Streptococcus pyogenes
MSENIPLRVQFKRMKAAEWARSDVILLESEIGFETDTGFARAGDGHNRFSDLGYISPLDYNLLTNKPNIDGLATKVETAQKLQQKADKETVYTKAESKQELDKKLNLKGGVMTGQLKFKPAATVAYSSSTGGAVNIDLSSTRGAGVVVYSDNDTSDGPLMSLRTGKETFNQSALFVDYKGTTNAVNIAMRHATTPNFSSALNITSGNENGSAMQLRGSEKALGTLKITHENPSIGADYDKNAARYPLILSKRQNGAGTAAQGIYINSTSGTTGKLLRIRNLSDDKFYVKSDGGFYAKETSQIDGNLKLKDPTANDHAATKAYVDKAISELKKLILKK

SEQ ID NO: 21 - DNA, 1497 bp, Bacteriophage T270
  CDS (286)..(1374)
gaagacattgtaaaatacaatacaattatgagagatcaatataaaaaaggtagcaatgaatataatgcgtttcaacaagatattgagcaagataaaaaccagatagcactattgttcaacgaacatcaattgcttgaaaatatcgataattagttaatctaaaacaaaaagccccacgctctcaaagtttggcgactctgagcgtgaggcaagacagtataagaaacaaccattaaaaaggtcattttcttgtacctattttatcaaattgaaagatggtatgcaatgaaaattaaatcatataaaaaggaaaatggtgaaactgcttataaatttcttttgtatgccggttatgttaatggaaagagaaaatatattaggcgagaaggtttcaaaactaagcaggctgcaagggaaaccttaattagtttacaagctgaacttgataaacctaaatcaagtatgacatttggagcattgacagatcaatggctaaaggaatatgaaaaaaccgttcagggcagtacctacttaaaaacagaaagaaatattaataaacatattttgccaaaacttgataaagtgaagattggagacatcaatccactacttatccagcggcttactgaagaatggtgcaacgatttaaaatatggaggaaaaattcttgggcttgttaggaatatcttaaatctagctgttagatacggatatatcaataacaatccagctttgccaattacacctccaaaaataaaaaggaaaagaaaaatgaataataatttttatacacttgatcaacttaaacaattccttgaactagttgaaaaaactgacaacattgaaaaaatagccttgtttagattattagcatttactggaatacgaaaaggggagcttctggcactaacttgggatgatttgaatggtaatactctatcaattaataaagctgtcacacgtactcaagttggactagaaatagatgttacgaagacaaaatcaagcgatagattaatcagcttagatgatgaaactttggaaattttacaagaacttcatgaaacttttcctacttctactcttatgttccaatctaaatcaggtggaattatgacgccaagtttaccacgaaaatggctattgcaaattatcaaagggatagacttaccacaaatcacaattcatggtttcaggcacactcatgcaagcttacttttcgaatcaggtctatccttgaaacaggtgcaacatagattagggcatggagatttacagacaactatgaacgtatatactcacatcacgcaatcggcaattgatgacattggaactaaattcaatcaatttgttactaacaagcaactagattgacaactaattctcaacaaacgttaatttaacaacattcaagtaactcccaccagctccatcaatgcttaccgtaagtaatcataacttactaaaaccttgttacatcaaggttttttctttttg

SEQ ID NO: 22 - protein, 362 aa, Bacteriophage T270
MKIKSYKKENGETAYKFLLYAGYVNGKRKYIRREGFKTKQAARETLISLQAELDKPKSSMTFGALTDQWLKEYEKTVQGSTYLKTERNINKHILPKLDKVKIGDINPLLIQRLTEEWCNDLKYGGKILGLVRNILNLAVRYGYINNNPALPITPPKIKRKRKMNNNFYTLDQLKQFLELVEKTDNIEKIALFRLLAFTGIRKGELLALTWDDLNGNTLSINKAVTRTQVGLEIDVTKTKSSDRLISLDDETLEILQELHETFPTSTLMFQSKSGGIMTPSLPRKWLLQIIKGIDLPQITIHGFRHTHASLLFESGLSLKQVQHRLGHGDLQTTMNVYTHITQSAIDDIGTKFNQFVTNKQLD

SEQ ID NO: 23 - DNA, 2187 bp, Staphylococcus aureus
  CDS (752)..(1744)
atcgataactttctttgttccatttttaaagtaaacagtatatttcgcttgcttcgatagtcttaaatctatatcactaatacctctgtctgattttaaaactgatttaactctatcctctaaatctttataactaatattttgattcttattaaatgttaagcttgataaaatattttggcttgtaccgttcacagtgattgcatatggaacatggactttagaatatccatggtgtaacgaacttgatgatttatctaatggcttagctgcggcagacgcttcattattattaaagtttgcacctgttgatgctaaaacacctaatgctaaagttgttgtaatcaatgacttaaatttcataaattatctctccttttttgtgtaattcgtatttgcaacttaattatagccagactttctctattttttgaattaactgaatattaataataaattatctttaacaataattttttaacactgttaaaagttcttttaattttgattaactaattaatttacaatacctaaaatgttgtttggttttgtttataccaagcttcaaacttaaatgtcataacaacattcatttcttaattccgattagatttgtcgattatatttacagcatctttatactcaaaaaacatttacttaaaaatataaattctatttaataattaatttaaatttagttaatcaattttgcatctattttgttgtaagctatataaaaggagtgataatgatggtgaaaaaaacaaaatccaattcactaaaaaaagttgcaacacttgcattagcaaatttattattagttggtgcacttactgacaatagtgccaaagccgaatctaagaaagatgatactgatttgaagttagttagtcataacgtttatatgttatcgaccgttttgtatccaaactgggggcaatataaacgcgctgatttaatcggacaatcttcttatattaaaaataatgatgtcgtaatattcaatgaagcatttgataatggtgcatcagacaaattattaagtaatgtgaaaaaagaatatccttatcaaacacctgtactcggccgttctcaatcagggtgggacaaaactgaaggtagctactcatcaactgttgcagaagatggtggcgtagcgattgtaagtaaatatcctattaaagaaaaaatccagcatgttttcaaaagcggttgtggattcgataatgatagcaacaaaggctttgtttatacaaaaatagagaaaaatggtaagaacgttcacgttatcggtacacatacacaatctgaagattcacgttgtggtgctggacatgatcgaaaaattagagctgaacaaatgaaagaaatcagtgactttgttaaaaagaaaaatatccctaaagatgaaacggtatatataggtggcgaccttaatgtcaataaaggcactccagagttcaaagatatgcttaaaaacttgaatgtaaatgatgttctatatgcaggtcataatagcacatgggaccctcaatcaaattcaattgcgaaatataattaccctaatggtaaaccagaacatttagactatatatttacagataaagatcataaacaaccaaaacaattagtcaatgaagttgtgactgaaaaacctaagccatgggatgtatatgcgttcccatattactacgtttacaatgatttttcagatcattacccaatcaaagcctatagtaaatagtgctcaactaactaataactttgcttcgttctaaaaggacgaagcgagttatattgttaaaatttgaattgacttacattttaataaaatcatcttaacaactttaatttttcattaatacaagtctttactctacactcaaacaagattcatacactgcacgtcataataaatctatctattcaaatataaataaaagttacctactacattctatgtagcaggcaacttttattacttatttcttttcattatcattaagtacttttacaaacttcacattatgtgtcttccaatcaacttcatataatgctgataatttttcttcttttttatctacatggttttcaccagaccaatagccccagaaaccatggcgattccaatctattttaaactcatccattgatcgtttaactctaacgtgtcgcatggaaatcgat

SEQ ID NO: 24 - protein, 330 aa, Staphylococcus aureus
MVKKTKSNSLKKVATLALANLLLVGALTDNSAKAESKKDDTDLKLVSHNVYMLSTVLYPNWGQYKRADLIGQSSYIKNNDVVIFNEAFDNGASDKLLSNVKKEYPYQTPVLGRSQSGWDKTEGSYSSTVAEDGGVAIVSKYPIKEKIQHVFKSGCGFDNDSNKGFVYTKIEKNGKNVHVIGTHTQSEDSRCGAGHDRKIRAEQMKEISDFVKKKNIPKDETVYIGGDLNVNKGTPEFKDMLKNLNVNDVLYAGHNSTWDPQSNSIAKYNYPNGKPEHLDYIFTDKDHKQPKQLVNEVVTEKPKPWDVYAFPYYYVYNDFSDHYPIKAYSK

SEQ ID NO: 25 - DNA, 17276 bp, Streptococcus agalactiae
  CDS (7062)..(8207)
acaatctcaggactgtttatttttatgattaaacgaaacttcctctaataaatagtcaataaatttttgtcccatttttgaaaggtttgctttgtcgtgtcggatatagacaatatcaataacatcatccacgtcaagagggattgcgacaatttcgtcaccgttcaattttgagttgaggataccagttgccactgtataaccatctaatccaatcattaaattaaacagagttgctctatcactgacaacaatggattttgggtgaggaatttgagacatcatttcctcagaaaagtagaaagaattatgcaggccttgatcataactcagataaggataatcttctaaatctttcatacttaatttttttctattagctaagggattggatttgctcacgaaaatatgaggtgtagtagtaaaaagagttgtggcaattaaggaattatcgtcgaataatttggttaatacatctctattatagctattaagaaacagaacaccaatctctgaacggaaatttttaacatcatcaataatttcccaagtcctagtttcacgtaaaaaaagttcgtattgggtcatgtctgtgccattaaagagagctacaaaagcgttaaccacaaatgcatagtgttgtgaagaaacgctgaacagctcacgacttgtattatcacccttataacgctcttcaagaagtgctgtttgttctagaatttgtcgcgcatatgacagaaattccataccatcttttgttaacgttattccttttggatttcgaataaaaatttggatacccatctcagtctcaaggttcctaacagcgtttgaaagtgaaggttgggtaatgtagagttgtttagcggcttcattcatgctaccagtttctacaatcttaataacatattgtaattgttgaattctcataattctagtttaaactagaatgtaaataaattcaattagatcagctaaattatcaatatagatcaattgaaaatgttatttagctaatataatcagattattccaatattattttcgttgaatattgtattgaaaaatgatataatatccaagtaaaattaaggtttttttaagtattggagaattacaatgtctaatcattcgcgccgtcaccaaaagaaacactcacatacacctctacgggtgattaatttatttcttttggtgatttttattttgttaagtgtagtctcattatttcttatgtatcgtcaccattttttggcatttagacacttgaacgtcatttatggagttgtaattattttaatcattttagcaagtttatttctttgtattaagaataaagctagaatttttacaactataattttagtactatcctctattttcgttgctactactttatatggatttaagtcaaccattgatttgacaaataatctaaataaaactgcttcatactctgaaattgagatgagtgtagttgtaccaaaagattctaaaataaccaatatagaagctgtcagcaaattagccgcaccagttaaaaacgatacttcaaatattactgatttgatagaacatataaaatcagaaaaaggaatctctattacaccacaaaaaacagattcttaccaggatgcatacaatagaattaaaaatggtgatagtcaagctatggttttaaataatgcttatgttagcttaattgaacttagtacccctgattttaaatcgcagataaaaacgatttatacttacaaaattaagaaaaaaattaatcgtaaaaatactaatcataaagaaggggtatttaatatctatattagcggtattgatacttttggctctatatcaacagtatcaagatctgatgtaaatattattatgacggttaataccaatacccacaaagtattgttaacgacaacaccacgagatgcctatgtaaaaattccagatggtgggggcaatcaatatgataaattaacccatgcaggtttgtatggtgttgagacatcaatgaaaacacttgaaaacctttacgacatcaaccttgattattatgctagaattaatttttcatcattttttaaaattaatagacctcttgggaggagtgacagtttatatacgatcaagcttttacaagtaaacatggtaattttggactttcctgttggtcaagtaacattgaattctgagcaggctttgggctttgttagagaacgttattctctacaaggaggcgataacgatagaggtagaaatcaagaaaaagtgattgcagctattataaataagttagcttctagtcagtcagtaacaaaattaaatagcattacctcacagctccaaacgtccgttcaaactaatatgactattgataatattaatgatttgattaacaatcaattgtcaactggacaacgcttcactgtcgagtcacaagcattaactggtcatggttcaacgggtgaactcccttcatatgcaatgccaggagctcaactttatatgatgtcaattgatcaatctagcttatctaatgcaaaatcaaaaattaagaacacaatggaggaataacaagaatgattgatattcattctcatatcgtttttgatgtagatgatgggcccaaaacgcttgaagagagtttatctttaatagaagaaagttatcgacaaggtgttagaataattgtttcgacatcacatagaagaaaaggtatgtttgaaacacctgaagatattatcttcaaaaacttttctatagttaaacacgaaacggaaaaaagatttgaacatcttcaaatcttatatggtggagaattatactatacaagtgatatgttagaaaaactgaagttaaagcaaattccaactttaaacaatacgaaatttgctttaattgaattttctatgcaaacttcttggaaagatattcatacagctttgtcaaatgttttaatgcttggtattacaccagtcgttgcgcatatagagaggtataacgctttagagaatcaaaaagaacgggtgaaggaaattattaatatggggtgttacacacaaataaatagtttccatattttgaaacaaaaactttttaatgataagcataaacgctttaagaaaagagcccgttattttttagaggaaaatttagtgcattttgtagcgagtgatatgcataaccttgatgttagaccgccatttttagcagaagcttataagattatctgtagagatttcggtaaagaacgtgctaaccaactttttattgaaaatgctcaatctatattaaaaaaccattacatttaggagatttcatgaataaaatagctaatacagaagttgaaataaatatattcaaccttttaaaaaaattgtggaaaaagaaatttttaatcacatttgttgccattgcgtttgcaacagctggacttttctatagtctttttattgttacgccacaatatacttcttcaacaaggatatatgtcattaaccctaatacccctaataatagtattactgcacaagatctacaagcggggagttttcttgcaaatgactataaggagattattacgtctactgacgttctagaaaaagttatttcttctgaaaaattgaattatccttcgtctcagttgctacaaaaaataacagtttctattttaaaagatacacgtgttatttcaatatcggtcgaagatgctaatccaaaaatgtctcaaaaattagcaaattcagttagagaagcagcagtttcaaaaatcaaggcagttactcaagtagaggatatcactactcttgagaagggaaatttacctaaagcaccatcttctcctaatattaaaaagaatgtactaatcgggtttattgttggtgcaggattatcaactattgttttagttattatggggattttggatgatcgtgttaatactgaagaagatattgaaaaggtcttaggacttacttctttaggtatagtaccagatttgaataaactttaaggagaatataatgactcgtttagaaatagttgatagcaagttaagacaagcaaaaaaaacagaagaatacttcaatgcgatccgtacaaacatacagtttagtggaaaggaaaataaaattcttgcaattgcctctgttagggaaggggaaggaaaatccactacttcaacaagtttagctttatctttagctcaagcaggatttaaaacattattaattgatgcggatactaggaactctgttatgtctggaacctttaaagcaactggaactattaaaggcttgacgaattatttatcaggtaatgcagatcttggagatattatctgtgaaaccaatgttcctagactgatggtcgttccttcaggaaaagtaccaccaaatccaacagcattacttcagaacgcttattttaataagatgattgaagctattaaaaatatatttgattatattatcatcgatactccacctattggtttagttgttgatgccgcaataatcgctaatgcttgcgatggttttattttagtaacccaagcaggcagaataaaacgtaattatgttgaaaaagcaaaagaacagatggaacaaagtggttcaaagttcttaggtattattcttaataaagttaatgaatctgttgctacttacggcgattatggaaattacggaaaaagggatagaaaaaggaagtaagggactctggtattgaaagaaaaagaaaatatacaaaagattattatagcgatgattcaaacagttgtagtttatttttctgcaagtttgacattaacattaattactcccaattttaaaagcaataaagatttattgtttgttctattgatacattatattgttttttatctttctgatttttacagagacttttggagtcgtggctatcttgaagagtttaaaatggtattgaaatacagcttttactatattttcatatcaagttcattattttttatttttaaaaactcttttacaacgacacgactttccttttttacttttattgctatgaattcgattttattatatctattgaattcatttttaaaatattatcgaaaatattcttacgctaagttttcacgagataccaaagttgttttgataacgaataaggattctttatcaaaaatgacctttaggaataaatacgaccataattatatcgctgtctgtatcttggactcctctgaaaaggattgttatgatttgaaacataactcgttaaggataataaacaaagatgctcttacttcagagttaacctgcttaactgttgatcaagcttttattaacatacccattgaattatttggtaaataccaaatacaagatattattaatgacattgaagcaatgggagtgattgtcaatgttaatgtagaggcacttagctttgataatataggagaaaagcgaatccaaacttttgaaggatatagtgttattacatattctatgaaattctataaatatagtcaccttatagcaaaacgatttttggatatcacgggtgctattataggtttgctcatatgtggcattgtggcaatttttctagttccgcaaatcagaaaagatggtggaccggctatcttttctcaaaatagagtaggtcgtaatggtaggatttttagattctataaattcagatcaatgcgagtagatgcagaacaaattaagaaagatttattagttcacaatcaaatgacagggctaatgtttaagttagaagatgatcctagaattactaaaataggaaaatttattcgaaaaacaagcatagatgagttgcctcaattctataatgttttaaaaggcgatatgagtttagcaggaacacgccctcccacagttgatgaatatgaaaagtataattcaacgcagaagcgacgccttagttttaagccaggaatcactggtttgtggcaaatatctggtagaaataatattactgattttgatgaaatcgtaaagttagatgttcaatatatcaatgaatggtctatttggtcagatattaagattattctcctaacactaaaggtagttttactcgggacaggagctaagtaaaggtaaggtttgaaaggaatataatgaaaatttgtctggttggttcaagtggtggtcatctagcacacttgaaccttttgaaacccatttgggaaaaagaagataggttttgggtaacctttgataaagaagatgctaggagtattctaagagaagagattgtatatcattgcttctttccaacaaaccgtaatgtcaaaaacttggtaaaaaatactattctagcttttaaggtccttagaaaagaaagaccagatgttatcatatcatctggtgccgctgtagcagtaccattcttttatattggtaagttatttggttgtaagaccgtttatatagaggttttcgacaggatagataaaccaactttgacaggaaaattagtgtatcctgtaacagataaatttattgttcagtgggaagaaatgaaaaaagtttatcctaaggcaattaatttaggaggaattttttaatgatttttgtcacagtggggacacatgaacagcagttcaaccgtcttattaaagaagttgatagattaaaagggacaggtgctattgatcaagaagtgttcattcaaacgggttactcagacttcgaacctcagaattgtcagtggtcaaaatttctctcatatgatgatatgaactcttacatgaaagaagctgagattgttatcacacatggcggcccagcgacgtttatgtcagttatttctttagggaaattaccagttgttgttcctaggagaaagcagtttggtgaacatatcaatgatcatcaaatacaatttttaaaaaaaattgcccacctgtatcccttggcttggattgaagatgtagatggacttgcggaagcgttgaaaaggaatatagctacagaaaaatatcagggaaataatgatatgttttgtcataaattagaaaaaattataggtgaaatatgaggaaatatctagatttagattattctttattttatgctctttgggtacttattttagtaccaaaccaatggtatcagtttttaattattaccattatagttctattattactttggaagagtgagtttagaatatctataagcaattcttcaatactatttctgctttggttatttatttatttatttgcaatactcattagaggtactcaagaggatataacgtttcagcgatttattgctgagctattaaaactaattagtacaggatatgctttatttttttataattattatagaaaagctgattttaatagttcagttgtaaggaatgtggtaaaggttaactattttgtgttgtttcttataacagttttatatttattttttcctatgctgaagccaactttatttggaagagaattgttttcaatagagtggtttccacatatgagaataagacttgcggcatattttgaatatgctacactaattggtcagtttattttattttcttatcccatactttttttgaaaccccaaaaacatatggaaaatattttaatatccttactgttgactatatgttcatacttttctggcgctagaatactattggtctgtatgttggttttattagcatcgcttcttttagattatatcctttttaaaactaatttgaaattgaccaagaaaaacacttttatacttggtatgactttcttatttatcaccgcttgtttttcttataacatatggtcaataattgaaaaaataattatgtacagaaaccaaagtactatcactaggatgatagtttatcaagaaagtattattgaagttctaaaaggaaatattttatttggacagggtataaggattccatcaagtgaaggaatattcctaggatcgcattctacttatattagtgtcttttacaggacttctttattaggaattgttctttatttttctgcctttatacttttatataaagaagcgatttcaaaaaattataaaatctacagattatttttttatacgttattatgttacacgctctttgaggaaatagatcctaatcattggagtattgtattattattctcaacttttggtatagtgggaagggctaaaaaatgaaagaaaaagtaacagtcattatacctatatacaactcagaagcataccttaaagaatgtgtgcaatccgtactacaacagactcatccattgatagaagttatactaattgatgatggatccactgataatagtggagaaatttgtgataatttatctcaggaagataatcgcatacttgtatttcataaaaaaaatggaggggtctcttcggcaaggaacctaggtctagataaatccacaggagaattcataacatttgtggatagtgatgattttgtagcaccgaatatgattgaaataatgttaaaaaatttaatcactgagaatgctgatatagcagaagtagattttgatatttcgaatgagagagattatagaaagaagaaaagacgaaacttttataaagtttttaagaataataactctttgaaagaatttttatcaggtaatagagtggaaaatattgtttgtacaaaattatataaaaaaagtataattggtaacttgaggtttgatgagaacttaaaaattggtgaggatttactttttaattgcaaactcttatgtcaagagcaccgtatagtcgtagatacgacttcttccttatatacttatcgaattgtaaaaacttctgtaatgaatcagaaattcaacgaaaactcattagattttataacaatttttaatgaaataagtagtttggttcctgccagattagctaattatgttgaagcgaaatttttaagagaaaagataaagtgtctccgaaaaatgtttgaattaggtagtaatattgacaataaaatcaaagtacaacgagagatttttttcaaagacattaaatcatacccgttctataaagcggtcaaatacttatcattaaagggattattaagcttttatttaatgaaatgttcacctaaactatatgttatggcatatagaagatttcaaaaacagtagctggagaaatttggaaagagaatttataacttcatgataaagaaaattgaaaaggatttaataagtgtaattgtacctatttataatgttgaagattatttagttgaatgtatagaaagccttattgttcaaacatatcgaaatattgaaatattattgattaatgatggttcgacggataattgtgcaacaattgccaaagaattttctgaaagagattgtagagttatctatatagaaaagtcgaatggtgggttgtcagaagctagaaactatggaatttatcattcaaagggaaaatacttaacttttgttgattcagatgataaagtttcctctgattacatagcgaatttgtataatgctattcaaaaacatgattcgtctatagctatcggtggctatttagaattttatgaaagacataatagcataagaaattatgaatatttagacaaagtgatatcagttgaagaagcactactaaacatgtatgacattaaaacttatggttcaatttttattactgcatggggaaaattattccataaatctatattcaatgatttagaatttgcattaaataagtatcatgaggatgagttctttaactataaagcatacttaaaagctaattctataacatacatagacaagcctctctatcattatcgtatacgagtaggtagtatcatgaataatagtgataatgttataattgctagaaagaaacttgatgttttatcagcattagacgagcgaataaaacttataacaagtttacgtaagtattccgtttttttacaaaaaacagaaatattttatgtcaatcaatattttaggactaaaaaatttttaaaacaacaatctgtaatgtttaaagaagataactatatcgatgcttatagaatgtatggacggttacttagaaaagtgaagttagttgataaattaaaacttataaaaaataggtttttctagaaatggctgtttaatagttgtaatgtgagtgaccacgaattgttggataactatcaaaaagactaatttaggggaaaaataaaatgactaattttgtttgtcatactttataccatctactgattactataataaagttaaaagataaagaaaatactagaatatttatttgtgacactatcacggattatgaaacttgggtaaagatattaaatgatcagggaataagaactgaatcatttaaagagtttgcttatcgggagcagttacaaaataaaaatattgaagaagtgatggagcttgtagattcagacttaaatcactactttgagagagtagatacacaagtctatctatttaatgatgatactttaataggtcgctatatggtgtatttaggtaaaaattatcatctaattgaagatggttataactgttttcaagccaagttattcttgggtggttctgtcgtaaaacgagtaattaaaacttacttatttaaaaagtatgttccgtatggtttttcaaaatattgtctctcaattgaggttaattctttagtggggttacctcatgacataaggagtaagaaatataaagaactaccgagaaaaaaattatttgatagtcttaacaaagaacaaaaatcactgattttcaaaatatttaaaacaaaaccattaactataactccaaagtcagtattattgttgacacagccacttgcacaagataaatgttataaaacacctacagagaggtttcaaagtattcaagagcaatacgattattttgacgatattgtccaggaatatagaacgttagggtacaatgtttatttaaaagttcatcctagagatgtagtagattattccaaattgccggtagagctattaccatcaaatgttcctatggaaattatagagttgatgtcaacaggtcggttcgaatgtgggataacacattcgtccactgcgctggattttttaacttgtgttgataaaaaaataactttagtagatctgaaggatattaaatgaatactaagaaattacttcaatctggttttatttatacactcgggaatttattggtgcaaggattagcctttatcacacttcccatctatactcgggttatctcaacagaagtttatggccaatatagtttatatgtcgcttggatgaatattattatgctttttattggccttcagacgagcggttctttaagttcagcccgggtcaaatacggagaagaatttaaaagctattcagggagtgccttttctgtaggtaatatatggtttcttattatacttttgatagcttttctatttagaagttttcttgcaccattagttggtttttctgaatctatttttttattaatggtgtgtcaaagttacgctagctatgtggtgactttctttggtcagtattttatacaacaacagaggagtttggctaatttaatattatccttagccaatgcagtttcatctgttgcactatctctatttttaatttttcattggtccgatgactttttatctagggtttttggagcttttgttcctactataataactggaatagttgcctttgcttatatttattatcatagcaaatctttttacaatcctaagtattttcggttcattgtcactgtgtctgttcccttgattttccatttgttaggacaccagttgttggggcaattagatagaattatgctagctcgtttatacaatactaaagaagttgcaatgtatagtttcggttattcgcttggaatgattattcagattgttttgaatagtattaatatggcttggattccatggttttttgatgctagaaaagaaaaattactgcaactttcaacttatattagccgttatctctacttaggagttttcttaacattaggttatttgactgtttttcctgagttagctcaaataatgggaggagacaagtatagtagtagtgttcaatttatttctttaattattgtcagctactttttagtttttctctatacatttcctgtaaatatccaattcttctatgctaatacgacatggattcctattgggacattattagctgctggtgtaaattggttactaaaccttgtattaattcctcattatgcagcctatggcgctgctatggctacaataatatcttatttagccttgttgatttttcatcatattgtttcgaaagttaaataccattattcagatgtctcagttaggcagtacatcattttaagtggtatagtatttagttatgctatgttaatgaacatgttcctagataatatcgttattagatggagtttaggaataattattcttatagtatatagcattgtttttcaaaaagtcattttagacttattgagtaaaaaaagaaggagaagataatggtttatattattgcagagattggttgcaatcataatggagatattaatcttgcgaaaaaaatggtagatgttgccgtgtcttgtggtgttgatgctgttaaatttcagacttttaaagctgagaaacttatttctaaatttgctcccaaagctgaatatcaaaaagcaactacaggaacagcagacagtcaacttgagatgacgaaacgtttagagttaagctttgaagaatacttagaaatgcgtgattatgcaatttcaaaaggtgtggagaccttttcaacaccttttgatgaagagtcattagagttcttaatttctacagatatgccaatttacaaaattccatcaggagaaatcactaatttaccttacttagaaaagattggcaagcaacaaaagaaagttattctttcgacgggtatggcggtaatggaagagatccatcaagcggtgaatattttacgtcagaatggtacaaccgacatttctattttacattgtacaacagagtacccaacaccttacccctctctaaatttaaacgttattcatactttgaaagatgaatttaaagatttaacgataggttattcggatcattcaattggatcagaagtacctatcgcagcagcagcaatgggtgcagaagttattgaaaaacactttactttagatactaatatggaaggtccggatcataaagccagtgcaacacctgatattttagctgctttagttaaaggggttcgcattgttgaacaagccttaggtagatttgaaaaaatcccagatccagtagaagagaaaaataagattgttgctcgtaaatcagtcgttgctttaaaaccaattaaaaaaggcgatatttattcaatagaaaatattacggtgaagcgcccaggtaatggtatttctcctatgaactggtatgacatcttgggacaagaagcgcaagatgatttcgaagaggatgaagttattcgtgattcacgctttgaaaatcaattgcccgagttataataacacctaattataatcggcaacagatgtattacacggctaagattatgtaattactatatatagaagggatacgatgaaaaaaatttgtttagtaaccggatcgcgtgctgaatacggaataatgaagccattgattcaaagattatcaaaagataaagaagtcaacttacaaattattgcaacagcaatgcatctggaagaaaagtacggctatacttatcgtcaaattgaagaagacggttttgatattgcttataaagttcccttacatctttatgatactgacagaagaactgtatctactgcaatggcgcatttacaactaggattgaccaaaatttttgacaaggaagactatgatctagtcatcattttaggggatcgttacgaaatgttaccagttgtgaatgtagcgttgatttataatgtcccagtatgccaccttcatggaggggagacctcattaggcaattttgatgagtatattcgccatgcaattactaagatgagtcacctacacttagtctctacagaggactttcgtcaacgtgtgattcagatgggagaacaacctcaatttgtaattaacacaggagctctcggagtggaaaatgctctatcaatcccttctctaaccaaagaagcaatagaaaagcaattaggtattgtactagaggaatcctattttgttgttctctatcatcctgttacttttgaacaaggaaaaagtgctggagaacagatgaaagcggtactatcagccctttctaaatttggtgtccagtgtctatttataggatccaattcagatactggttctgatgatattgcaaaggctatcaatacttatttgataaatcatgaaaatagttattgctttgcttctttatcaacccaactttatcattccttaattcgtcattcactaggactgattggtaattcgtcttctggtttaatagaagttccttctttgatgaaacctactcttaatattggtgatcgccaaaaaggtaggctacatggagaaagtgtagtaagtgtaccagtcgaaaccccctctgtattggagggattatcaaaattgaatgaagtgaccaactttgacaatccctactacaaagagaatgcttcatctattgcatatgaagcaataaagctttatttgaaagatgaaccttcaatttcccaaccattttatgatttaaaggagaataatctaaaatgaaaaaaaagttggcatttttaggcgcaggaagtcatgctgatgcgattgctccggttattgatcctcttgtgtatgatttcgtaggtttttttgatgataaagatattacggagcatgatggttatcctgttcttggaaaactttatgatgtgctaccttaccttgaagatggctcaatagatgcagtatttattacaataggtgataatgctaaaaggaaagaactatttgaatatgtagcaaaggattattatgactttattattaacatcattagtcccaatgctttagtattgacaccagatagtatttgtgggcgtggtatctttattggttttggggcttttataggttctaaagtgaagctgtttgataacaacgttgttaatacaggagcgctcattgaacatcatactgttgtagaatcacactgtaatatagcacctaatgctaccataaatggtctttgttatattagagaagaagtttatgtaggtagtgccagtgttattattcaaaccttggatatttcatcgtgtacgacaattggcgcaggagctgttgttgtaaaagatattatagaacctggaacctatgtaggggttccagccaaaaaaataaaataaaggatatgttatgaagccaatttgtattattcctgcgcgatcagggtcaaaaggattaccagataagaatatgttattcctagcaggtaaacccatgattttccatactatagatgctgcaattgaatctggaatgtttgataagaaagatatttttgttagtacagattcagaattgtacagagagatttgtttagaacgcggtatttcagtggtgatgagaaaaccggaactttcaactgatcaggcaacttcgtatgatatgttaaaagattttttatctgactatgaagataatcaggagtttgtgttacttcaagtaacctctccactaagaaaatcatggcatataaaggaagcaatggagtattattcttcacatgatgttgacaatgttgtaagtttttctgaagttgagaaacaccctggtctgtttacgacattgtctgataaaggctatgctatagatatggtgggagcagataaaggttatcgtcgccaagatttacaacctttatactatccgaacggcgctatttttatttctaataaagaaacttacttaagggaaaaaagctttttcacctctaggacatatgcttatcaaatggcaaaggaattttcattagatgttgatacgagagatgattttatccacgtcatcggtcacctctttttcgattatgccattagggaaaaagagaataaagttttttataaagaaggctatagtcgtttgttcaatagagaagcttcaaagataattttaggtgattcaaaaacgatatctatctcactagaaaattaccataattattcccaaggtggtgtaacattagcaacgatgttggaaaacttacctaactttttgacagctaatgtaacagaggcttttgtttctataggggtaaatgatctcattacaggttatagtgtggaagaaatattcagcaatttccaaaaactctactcattattagctgagaataaaataaagatgagatttacaactattgcttacaccctttttagagaaactgtcaataatgcagatattgagaaaatcaatcaatggctaacagaattttgttatcaaaatcagattccactgttagatattaatagatttttatcaaaggatggtaatctaaattatcatttaactagtgatggattgcattttgactcaagaggctaatgatttgtaacaaagtcaatatcaattatttgtagacgaagttaaaaccttataatatttattttataaaattattcatcttattttggcgatttcaatagtgatatggtatatttaaagtaagctacgtatagttttaccagtcagaaatagtaaggatggttgagtatgagagaaactgaaacacacgatcaccaagcgctaattcaaaaattgttagtcagtattcattatttaaccttgtttcgtgatgaaattatattagtagaaaaaaccccatctttactggggaaacatttttctattgctattgtgcagaatgaactaggtgagatactttctaaaatagaagctttgagtaagcaaaaaaaactgattcgttctatttattggtatgatgaatcgtcatttaaagtcatgaataaggctctggctattgtagaagaatggattaagggcttagataatcttttagaattctgtcaatcacagacggtttttcaagcaattttaggtgatgaacgtgcacatgtatttggaatccttattgatgtttatacttctttaaacattataaatacttctttgaaagaagaaaattctaga

SEQ ID NO: 26 - protein, 381 aa, Streptococcus agalactiae
MRKYLDLDYSLFYALWVLILVPNQWYQFLIITIIVLLLLWKSEFRISISNSSILFLLWLFIYLFAILIRGTQEDITFQRFIAELLKLISTGYALFFYNYYRKADFNSSVVRNVVKVNYFVLFLITVLYLFFPMLKPTLFGRELFSIEWFPHMRIRLAAYFEYATLIGQFILFSYPILFLKPQKHMENILISLLLTICSYFSGARILLVCMLVLLASLLLDYILFKTNLKLTKKNTFILGMTFLFITACFSYNIWSIIEKIIMYRNQSTITRMIVYQESIIEVLKGNILFGQGIRIPSSEGIFLGSHSTYISVFYRTSLLGIVLYFSAFILLYKEAISKNYKIYRLFFYTLLCYTLFEEIDPNHWSIVLLFSTFGIVGRAKK

SEQ ID NO: 27 - DNA, 3042 bp, Staphylococcus aureus
  CDS (149)..(2296)
actattgtatattgcaaagctaattaactataacaaaaagatagttaatgctttgtttattctagttaatatatagttaatgtcttttaatattttgtttctttaatgtgtagattgggcaattacattttggaggaattaaaaaattatgaaaaagcaaataatttcgctaggcgcattagcagttgcatctagcttatttacatgggataacaaagcagatgcgatagtaacaaaggattatagcaaagagtcaagagtgaatgagaacagtaaatatgggacattaatttcagactggtatttaaaagggagattaactagtctagaatctcaatttatcaatgcattggatattttagagacatatcattatggcgaaaaagagtataaagatgcaaaagataaattgatgacaagaattttaggggaagaccaataccttttagaaagaaaaaaagtgcagtatgaggaatacaaaaaattataccaaaaatataaagaagagaatccaacctctaaaggcttaaaactgaaaacattcgatcaatatacaatagaagatttaactatgagggaatataatgagttaacagaatcattaaaaagtgctgtaaaagactttgagaaagatgttgaaaaaatagaaaatcaacatcatgatttgaaaccatttactgatgaaatggaagagaaggctacttctagagttgatgatttagcaaataaagcatatagtgtttattttgcatttgttagggatacacaacataaaactgaggcattagagttaaaagcgaaagtagatttagttttaggtgatgaggataaaccgcatcgtatttctaatgaaagaattgaaaaagaaatgataaaagatttagaatctattattgaagatttctttatagaaactggtttaaataagcctggtaatattacgagttatgatagtagtaaacatcactataaaaatcacagtgaaggttttgaggctctagtcaaagaaacaagagaagcagtagcaaacgctgacgaatcttggaaaactaaaactgtaaaaaaatacggtgaatctgaaacaaaatctcctgttgtaaaagaagagaacaaagttgaagaccctcaatcacctaaatttgataaccaacaagaggttaaaactacggctggtaaagctgaagaaacaacacaaccagttgcacaaccattagttaaaattccacagggcacaattacaggtgaaattgtgaaaggtccggaatatccaacgatggaaaataaaacgttacaaggtgaaatcgttcaaggtccagatttcccaacaatggaacaaagcggtccatctttaagcgacaattatactcaaccgacgacaccgaaccctattttagaaggtcttgaaggtagctcatctaaacttgaaataaaaccacaaggtactgaatcaacgttgaaaggtattcaaggagaatcaagtgatattgaagttaaacctcaagcaactgaaacaacagaagcttctcaatatggtccgagaccgcaatttaacaaaacacctaagtatgtgaaatatagagatgctggtacaggtattcgtgaatacaacgatggaacatttggatatgaagcgagaccaagattcaacaagccatcagaaacaaacgcatacaacgtaacgacaaatcaagatggcacagtatcatacggcgcccgcccaacacaaaacaaggcatcagaaacaaacgcatataacgtaacaacacatgcaaacggccaagtatcatacggagctcgcccaacacaaaagaagccaagcgaaacaaatgcatataacgtaacaacacatgcaaacggccaagtatcatatggcgcccgcccgacatacaacaagccaagcgaaacaaatgcatataacgtaacaacacacggaaatggccaagtatcatatggagctcgtccgacatacaagaaaccaagtaaaacaaatgcatataacgtaacaacacatgcaaacggccaagtgtcatacggagctcgcccaacacaaaacaagccaagcgaaacaaacgcatataacgtaacaacacatgcaaatggccaagtatcatacggagctcgcccaacacaaaacaagccaagcgaaacaaacgcatataacgtaacaacacacggaaacggtcaagtgtcatacggcgctcgtccgacatacaacaagccaagtaaaacaaatgcatacaatgtaacaacacatgcagatggtactgcgacatatggtcctagagtaacaaaataagtttataactctatccatagacatacagtcaatacaatacaaaacattacgtatctttacaacagtaatcatgcattctatgatgcttctaactgaattaaagcatcgaacaatcgaaagcatatttctaaattatttattcattatagtcttaaacataacatgacctaatatattactaacctattaaaataaaccacgcacatctatgtgatatacgacaatcacagcaataataattgctttagaaagtcgtaccgaactggaacttacaagtctagttcgaacacactgatgtgagtggttttctttattttaaacatgaacaatcagataagttactagcattagcaaatattattaaatcaaagggcttcgattcataaaatttaaaacaatgattaaaattagacgtgtaaatgttaaattctaaaacggaaatacccgctatcctattaaaccactttttggttcaatcactatatttcacacagcttcaataataaaacgaaactgcttcaatccgcttcaacttcaacctacctcattcagtaaccaaacgaatccgcttcatccaaaatcaaccattctaacgcacatactcaaatatagcagctgcacccataccgacaccaatacacatcgtaaccatgccgtaacggctatcgggacgtctacccatttcattaagtaaacgcgcggttaacattgctcctgtagcacctaatggatgacctaaagcaata

SEQ ID NO: 28 - protein, 715 aa, Staphylococcus aureus
MKKQIISLGALAVASSLFTWDNKADAIVTKDYSKESRVNENSKYGTLISDWYLKGRLTSLESQFINALDILETYHYGEKEYKDAKDKLMTRILGEDQYLLERKKVQYEEYKKLYQKYKEENPTSKGLKLKTFDQYTIEDLTMREYNELTESLKSAVKDFEKDVEKIENQHHDLKPFTDEMEEKATSRVDDLANKAYSVYFAFVRDTQHKTEALELKAKVDLVLGDEDKPHRISNERIEKEMIKDLESIIEDFFIETGLNKPGNITSYDSSKHHYKNHSEGFEALVKETREAVANADESWKTKTVKKYGESETKSPVVKEENKVEDPQSPKFDNQQEVKTTAGKAEETTQPVAQPLVKIPQGTITGEIVKGPEYPTMENKTLQGEIVQGPDFPTMEQSGPSLSDNYTQPTTPNPILEGLEGSSSKLEIKPQGTESTLKGIQGESSDIEVKPQATETTEASQYGPRPQFNKTPKYVKYRDAGTGIREYNDGTFGYEARPRFNKPSETNAYNVTTNQDGTVSYGARPTQNKASETNAYNVTTHANGQVSYGARPTQKKPSETNAYNVTTHANGQVSYGARPTYNKPSETNAYNVTTHGNGQVSYGARPTYKKPSKTNAYNVTTHANGQVSYGARPTQNKPSETNAYNVTTHANGQVSYGARPTQNKPSETNAYNVTTHGNGQVSYGARPTYNKPSKTNAYNVTTHADGTATYGPRVTK

SEQ ID NO: 29 - DNA, 2252 bp, Staphylococcus aureus
  CDS (698)..(2224)
gaattcacaattctagctattatcacttctcaaaataaaaacatcgttcttcttaaagatttaattgaaacaatccaccataaataccctcaaactgttagagctctcaataatttaaaaaagcaaggctatctaataaaagaacggctcaactgaagatgaaagaaaaattttaattcatatgaatgacgcgcagcaagaccatgctgaacaattattagctcaagtgaatcaattattggcagataaaaatcatttacatcttgtttttgaataatatctctattacgcaagtgtgctgtattctaaagtgccattgtgttttctattttttaataaaacctcagcacattatgaacaactttctattttctatatctcttaaaaccatttccgaaattaaacctcagcacattcaaaattccattttattcttaaaaatattttttaactcatatgtaataaaccgctttcattataaaaaatatctatatattttatctgtttttattaatcggaatagcgtgattttgcggttttaagccttttacttcctgaataaatctttggacaaaatttttattttataagttgtaaaacttacctttaaatttaattataaatatagattttagtattgcaatacataattcgttatattatgatgactttacaaatacatacagggggtattaatttgaaaaagaaaaacatttattcaattcgtaaactaggtgtaggtattgcatctgtaactttaggtacattacttatatctggtggcgtaacacctgctgcaaatgctgcgcaacacgatgaagctcaacaaaatgctttttatcaagtgttaaatatgcctaacttaaacgctgatcaacgtaatggttttatccaaagccttaaagatgatccaagccaaagtgctaacgttttaggtgaagctcaaaaacttaatgactctcaagctccaaaagctgatgcgcaacaaaataagttcaacaaagatcaacaaagcgccttctatgaaatcttgaacatgcctaacttaaacgaagagcaacgcaatggtttcattcaaagtcttaaagacgatccaagccaaagcactaacgttttaggtgaagctaaaaaattaaacgaatctcaagcaccgaaagctgacaacaatttcaacaaagaacaacaaaatgctttctatgaaatcttgaacatgcctaacttgaacgaagaacaacgcaatggtttcatccaaagcttaaaagatgacccaagtcaaagtgctaaccttttagcagaagctaaaaagttaaatgaatctcaagcaccgaaagctgataacaaattcaacaaagaacaacaaaatgctttctatgaaatcttacatttacctaacttaaatgaagaacaacgcaatggtttcatccaaagcttaaaagatgacccaagccaaagcgctaaccttttagcagaagctaaaaagctaaatgatgcacaagcaccaaaagctgacaacaaattcaacaaagaacaacaaaatgctttctatgaaattttacatttacctaacttaactgaagaacaacgtaacggcttcatccaaagccttaaagacgatccttcagtgagcaaagaaattttagcagaagctaaaaagctaaacgatgctcaagcaccaaaagaggaagacaacaacaagcctggtaaagaagacggcaacaaacctggtaaagaagacggcaacaaacctggtaaagaagacaacaaaaaacctggcaaagaagacggcaacaaacctggtaaagaagacaacaaaaaacctggcaaagaagatggcaacaaacctggtaaagaagacggcaacaagcctggtaaagaagatggcaacaagcctggtaaagaagatggcaacaagcctggtaaagaagacggcaacggagtacatgtcgttaaacctggtgatacagtaaatgacattgcaaaagcaaacggcactactgctgacaaaattgctgcagataacaaattagctgataaaaacatgatcaaacctggtcaagaacttgttgttgataagaagcaaccagcaaaccatgcagatgctaacaaagctcaagcattaccagaaactggtgaagaaaatccattcatcggtacaactgtatttggtggattatcattagcgttaggtgcagcgttattagctggacgtcgtcgcgaactataaaaacaaacaatacacaacgatagatatc

SEQ ID NO: 30 - protein, 508 aa, Staphylococcus aureus
LKKKNIYSIRKLGVGIASVTLGTLLISGGVTPAANAAQHDEAQQNAFYQVLNMPNLNADQRNGFIQSLKDDPSQSANVLGEAQKLNDSQAPKADAQQNKFNKDQQSAFYEILNMPNLNEEQRNGFIQSLKDDPSQSTNVLGEAKKLNESQAPKADNNFNKEQQNAFYEILNMPNLNEEQRNGFIQSLKDDPSQSANLLAEAKKLNESQAPKADNKFNKEQQNAFYEILHLPNLNEEQRNGFIQSLKDDPSQSANLLAEAKKLNDAQAPKADNKFNKEQQNAFYEILHLPNLTEEQRNGFIQSLKDDPSVSKEILAEAKKLNDAQAPKEEDNNKPGKEDGNKPGKEDGNKPGKEDNKKPGKEDGNKPGKEDNKKPGKEDGNKPGKEDGNKPGKEDGNKPGKEDGNKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 31 - DNA, 324 bp, Staphylococcus aureus
  CDS (1)..(306)
  CDS (310)..(315)
atgcggggttctcatcatcatcatcatcatggtatggctagcatgactggtggacagcaaatgggtcgggatctgtacgacgatgacgataaggatccgagctcgagaggatccaaagctgatgcgcaacaaaataacttcaacaaagatcaacaaagcgccttctatgaaatcttgaacatgcctaacttaaacgaagcgcaacgcaacggcttcattcaaagtcttaaagacgacccaagccaaagcactaacgttttaggtgaagctaaaaaattaaacgaatctcaagcagggaaactagtttagaaagcttgatccggc

SEQ ID NO: 32 - protein, 104 aa, Staphylococcus aureus
MRGSHHHHHHGMASMTGGQQMGRDLYDDDDKDPSSRGSKADAQQNNFNKDQQSAFYEILNMPNLNEAQRNGFIQSLKDDPSQSTNVLGEAKKLNESQAGKLVKA

SEQ ID NO: 33 - protein, 60 aa, Staphylococcus aureus
TADNKFNKEQQNAFYEILHLPNLNEEQRNGFIQSLKDDPSQSANLLAEAKKLNDAQAPKA

SEQ ID NO: 34 - DNA, 2593 bp, Homo sapiens
  CDS (56)..(508)
agttgtctttggtagttttttgcactaacttcaggaaccagctcatgatctcaggatgtatggaaaaataatctttgtattactattgtcagcaattgtgagcatatcagcatcaagtaccactggtgtggcaatgcacacttcaacctcttcttcagtcacaaagagttacatctcatcacagacaaatgatacgcacaaacgggacacatatgcagccactcctagagctcatgaagtttcagaaatttctgttagaactgtttaccctccagaagaggaaaccggagaaagggtacaacttgcccatcatttctctgaaccagagataacactcattatttttggggtgatggctggtgttattggaacgatcctcttaatttcttacggtattcgccgactgataaagaaaagcccatctgatgtaaaacctctcccctcacctgacacagacgtgcctttaagttctgttgaaatagaaaatccagagacaagtgatcaatgagaatctgttcaccaaaccaaatgtggaaagaacacaaagaagacataagacttcagtcaagtgaaaaattaacatgtggactggacactccaataaattatatacctgcctaagttgtacaatttcagaatgcaattttcattataatgagttccagtgactcaatgatggggaaaaaaatctctgctcattaatatttcaagataaagaacaaatgtttccttgaatgcttgcttttgtgtgttagcataatttttagaattgtttgagaattctgatccaaaactttagttgaattcatctacgtttgtttaatattaacttaacctattctattgtattataatgatgattctgtcaaatgaaaggcttgaaatacctagatgaagtttagattttcttcctattgtaaacttttgagtctggtttcattgttttaaataaattaaggggacactaaagtcctatcattcattccttcattctgaacaggcaagatataatattacatgaatgattactatattttgttcacactaataaagcttatgctcagaaatgccatacacacacacaaacacacacatttatcatttaatgcataaatcaacacaaaaggttttcccattaatatgaaatattacatatatataagtgccatatttaaaataatttgtctaacagtagaactatgtcggagcactcactgaagcttcgatttcccactgaaagagttatttgttgtaagtagagttatcccggagaaggaaaaagaacttacgacctttctttataacagaaagctcaactctaaattcaacaagatgtgcaaaccggacatgcaggtgaatattttaataggttactataaggttctcaattaaattctttaatctgtccagtcccagtttctcttattaataaaactttggaaattgctttaaaccatttaaaggaaatttctagatatagaaactaaaggactgtgactatacagtgtcactcatttgtagtaaaacttaaaaagcaaaaacaaaaaacaaaaaagaccttcctgtgatactttatttccgaactaataaaaatctatatgactttttattattgtgtgataaccaagtaaatgttttctattttcgatattttcaggcatggtaacagaaatttaccttttaataaattaaaaaatctaaattttaacctacttgtatgttcggagagtgtttttgtactatattgactacttaaaatagagaatgagactaagaagggaacatttctgttgatacatgttttttaaaagtaatttttaagagcattattaggttaatttaatccaattaatgacccaaatgccaaggtaattttaaatttacatttttaataaaagcaacatgttgaaacaagagagggtgagattaacctttttgctaaagtaatttacaagtcaaagacaggaagagatcagagtgaatgtgccttcttaaccagagctacagaatttagtgaataattaaagtacaaactgctttgacctccttgaacttttccaagcaatttctctgtacttctatatatgaatgtcttagccaattttctgctactataacagaatacgacagactgggtaatttaaaaagaaaagaaatttattttcttcctagttctggaggctgggaaggcgaagggcatggcactgacatctgccttgtaactgatgagaaccttcttactgcatgataacaaagcagcaaggcaagcaaaagcgtaagatgaagagagaggaaatgaagccaaacacatcctttcatcagaagcccattccctctataaggcgttactacatttatgagaatggagtcctcatgacctaatcgtgaccttaaaggcccctcccaacactgttacaatggcaattaaatttcaacaaaggttccagaggtgacattcgaatcagcaatgaaattttcatagttaaatttggtattcgtgggggaagaaatgaccatttcccttgtatttttataattaaatcagcaaaatattgtaataaagaaatctttcctgtgaagataccatgacccc

SEQ ID NO: 35 - protein, 150 aa, Homo sapiens
MYGKIIFVLLLSAIVSISASSTTGVAMHTSTSSSVTKSYISSQTNDTHKRDTYAATPRAHEVSEISVRTVYPPEEETGERVQLAHHFSEPEITLIIFGVMAGVIGTILLISYGIRRLIKKSPSDVKPLPSPDTDVPLSSVEIENPETSDQ

SEQ ID NO: 36 - DNA, 5185 bp, Homo sapiens
  CDS (104)..(4474)
gggaacttggattaggtggagaggcagttggggggcctcgttgttttgcgtcttagttccgccctcctgtccatcaggagaaggaaaggataaaccctgggccatgaggctacccctgctcctggtttttgcctctgtcattccgggtgctgttctcctactggacaccaggcaatttttaatctataatgaagatcacaagcgctgcgtggatgcagtgagtcccagtgccgtccaaaccgcagcttgcaaccaggatgccgaatcacagaaattccgatgggtgtccgaatctcagattatgagtgttgcatttaaattatgcctgggagtgccatcaaaaacagactgggttgctatcactctctatgcctgtgactcaaaaagtgaatttcagaaatgggagtgcaaaaatgacacacttttggggatcaaaggagaagatttattttttaactacggcaacagacaagaaaagaatattatgctctacaagggatcgggtttatggagcaggtggaagatctatggaaccacagacaatctgtgctccagaggttatgaagccatgtatacgctactaggcaatgccaatggagcaacctgtgcattcccgttcaagtttgaaaacaagtggtacgcagattgcacgagtgctgggcggtcggatggatggctctggtgcggaaccactactgactatgacacagacaagctatttggatattgtccattgaaatttgagggcagtgaaagcttatggaataaagacccgctgaccagcgtttcctaccagataaactccaaatccgctttaacgtggcaccaagcgaggaaaagctgccaacaacagaacgctgagctcctgagcatcacagagatacatgagcaaacatacctgacaggattaaccagttccttgacctcaggactctggattggacttaacagtctgagcttcaacagcggttggcagtggagtgaccgcagtcctttccgatatttgaactggttaccaggaagtccatcagctgaacctggaaaaagctgtgtgtcactaaatcctggaaaaaatgctaaatgggaaaatctggaatgtgttcagaaactgggctatatttgcaaaaagggcaacaccactttaaattcttttgttattccctcagaaagtgatgtgcctactcactgtcctagtcagtggtggccgtatgccggtcactgttacaagattcacagagatgagaaaaaaatccagagggatgctctgaccacctgcaggaaggaaggcggtgacctcacaagtatccacaccatcgaggaattggactttattatctcccagctaggatatgagccaaatgacgaattgtggatcggcttaaatgacattaagattcaaatgtactttgagtggagtgatgggacccctgtaacgtttaccaaatggcttcgtggagaaccaagccatgaaaacaacagacaggaggattgtgtggtgatgaaaggcaaggatgggtactgggcagatcggggctgtgagtggcctcttggctacatctgcaagatgaaatcacgaagccaaggtccagaaatagtggaagtcgaaaaaggctgcaggaaaggctggaaaaaacatcacttttactgctatatgattggacatacgctttcaacatttgcagaagcaaaccaaacctgtaataatgagaatgcttatttaacaactattgaagacagatatgaacaagccttcctgactagtttcgttggcttaaggcctgaaaaatatttctggacaggactttcagatatacaaaccaaagggacttttcagtggaccatcgaggaagaggttcggttcacccactggaattcagatatgccagggcgaaagccagggtgtgttgccatgagaaccgggattgcagggggcttatgggatgttttgaaatgtgatgaaaaggcaaaatttgtgtgcaagcactgggcagaaggagtaacccacccaccgaagcccacgacgactcccgaacccaaatgtccggaggattggggcgccagcagtagaacaagcttgtgtttcaagctgtatgcaaaaggaaaacatgagaagaaaacgtggtttgaatctcgagatttttgtcgagctctgggtggagacttagctagcatcaataacaaagaggaacagcaaacaatatggcgattaataacagctagtggaagctaccacaaactgttttggttgggattgacatatggaagcccttcagaaggttttacttggagtgatggttctcctgtttcatatgaaaactgggcttatggagaacctaataattatcaaaatgttgaatactgtggtgagctgaaaggtgaccctactatgtcttggaatgatattaattgtgaacaccttaacaactggatttgccagatacaaaaaggacaaacaccaaaacctgagccaacaccagctcctcaagacaatccaccagttactgaagatgggtgggttatttacaaagactaccagtattatttcagcaaagagaaggaaaccatggacaatgcgcgagcgttttgcaagaggaattttggtgatcttgtttctattcaaagtgaaagtgaaaagaagtttctatggaaatatgtaaacagaaatgatgcacagtctgcatattttattggtttattgatcagcttggataaaaagtttgcttggatggatggaagcaaagtggattacgtgtcttgggccacaggtgaacccaattttgcaaatgaagatgaaaactgtgtgaccatgtattcaaattcagggttttggaatgacattaactgtggctatccaaacgccttcatttgccagcgacataacagtagtatcaatgctaccacagttatgcctaccatgccctcggtcccatcagggtgcaaggaaggttggaatttctacagcaacaagtgtttcaaaatctttggatttatggaagaagaaagaaaaaattggcaagaggcacgaaaagcttgtataggctttggagggaatctggtctccatacaaaatgaaaaagagcaagcatttcttacctatcacatgaaggactccactttcagtgcctggactgggctgaatgatgtcaattcagaacacacgttcctttggacggatggacgaggagtccattacacaaactgggggaaaggttaccctggtggaagaagaagcagtctttcttatgaagatgctgactgtgttgttattattggaggtgcatcaaatgaagcaggaaaatggatggatgatacctgcgacagtaaacgaggctacatatgccagacacgatccgacccttccttgactaatcctccagcaacgattcaaacagatggctttgttaaatatggcaaaagcagctattcactcatgagacaaaaatttcaatggcatgaagcggagacatactgcaagcttcacaattcccttatagccagcattctggatccctacagtaatgcatttgcgtggctgcagatggaaacatctaatgaacgtgtgtggatcgccctgaacagtaacttgactgataatcaatacacttggactgataagtggagggtgaggtacactaactgggctgctgatgagcccaaattgaaatcagcatgtgtttatctggatcttgatggctactggaagacagcacattgcaatgaaagtttttactttctctgtaaaagatcagatgaaatccctgctactgaacccccacaactgcctggcagatgcccggagtcagatcacacagcatggattcctttccatggtcactgttactatattgagtcctcatatacaagaaactggggccaagcttctctggaatgtcttcgaatgggttcctctctggtttccattgaaagtgctgcagaatccagttttctgtcatatcgggttgagccacttaaaagtaaaaccaatttttggataggattgttcagaaatgttgaagggacgtggctgtggataaataacagtccggtctcctttgtcaactggaacacaggagatccctctggtgaacggaatgattgtgtagctttacatgcgtcttctgggttttggagtaatattcactgttcttcctacaaaggatatatttgtaaaagaccaaaaattattgatgctaaacctactcatgaattacttacaacaaaagctgacacaaggaagatggacccttctaaaccgtcttccaacgtggccggagtagtcatcattgtgatcctcctgattttaacgggtgctggccttgccgcctatttcttttataagaaaagacgtgtgcacctacctcaagagggcgcctttgaaaacactctgtattttaacagtcagtcaagcccaggaactagtgatatgaaagatctcgtgggcaatattgaacagaatgaacactcggtcatctagtacctcaatgcgattctgagatatttgaatttcataaaattgtaactgaaatttaaaatttttagttcaatgtgattgttttctttaaaatgagtactgaattgtactggtctgtccttttttcctttgcctaattgaagaaataattgcttgttttctagcctggcaagatattttcataaaagagggataacaatgctgattactaccttttaaaatattttagataaatgcacagcaccacagcaccacatctaagcattagtgatgggtagctgatgtcagcttcatgtggattttaagcactctagaaacaatgaagcttcttggcatattttaaggagctcccaaaatgtgttacctattaaattgtaactcagcaagtagaagaccatttgaaaagtcaggtacaaatttcctcaagtggcataaaaatgtagtcagttttctcttttaccagtttttatttccactccaattatttagaactttatttgtacatgtgcagaagaataaggcagctgagaatcttgtttcccccaagagagttttacaggctgagtgttgcaaatgtgttctttgtcctgttatatgtatatcaggaatacaaggatgtgaaataaaactgtaaatttgcataactggatgtacttagataatgtgaaataaacattaaagacaaggtctatttttaataaaaaaaaaaaaaaa

SEQ ID NO: 37 - protein, 1456 aa, Homo sapiens [sequence omitted]

SEQ ID NO: 38 - DNA, 780 bp, Homo sapiens
gtgtatctctcagagtgcaagactgggaatggaaagaattacagagggacgatgtccaaaacaaaaaatggcatcacctgtcaaaaatggagttccacttctccccacagacctagattctcacctgctacacacccctcagagggactggaggagaactactgcaggaatccagacaacgatccgcaggggccctggtgctatactactgatccagaaaagagatatgactactgcgacattcttgagtgtgaagaggaatgtatgcattgcagtggagaaaactatgacggcaaaatttccaagaccatgtctggactggaatgccaggcctgggactctcagagcccacacgctcatggatacattccttccaaatttccaaacaagaacctgaagaagaattactgtcgtaaccccgatagggagctgcggccttggtgtttcaccaccgaccccaacaagcgctgggaactttgtgacatcccccgctgcacaacacctccaccatcttctggtcccacctaccagtgtctgaagggaacaggtgaaaactatcgcgggaatgtggctgttaccgtgtccgggcacacctgtcagcactggagtgcacagacccctcacacacatgaaaggacaccagaaaacttcccctgcaaaaatttggatgaaaactactgccgcaatcctgacggaaaaagggccccatggtgccatacaaccaacagccaagtgcggtgggagtactgtaagataccgtcctgtgactcctccccagta

SEQ ID NO: 39 - DNA, 1449 bp, Homo sapiens
  CDS (1)..(1449)
atggcgtctttctctgctgagaccaattcaactgacctactctcacagccatggaatgagcccccagtaattctctccatggtcattctcagccttacttttttactgggattgccaggcaatgggctggtgctgtgggtggctggcctgaagatgcagcggacagtgaacacaatttggttcctccacctcaccttggcggacctcctctgctgcctctccttgcccttctcgctggctcacttggctctccagggacagtggccctacggcaggttcctatgcaagctcatcccctccatcattgtcctcaacatgtttgccagtgtcttcctgcttactgccattagcctggatcgctgtcttgtggtattcaagccaatctggtgtcagaatcatcgcaatgtagggatggcctgctctatctgtggatgtatctgggtggtggcttttgtgatgtgcattcctgtgttcgtgtaccgggaaatcttcactacagacaaccataatagatgtggctacaaatttggtctctccagctcattagattatccagacttttatggagatccactagaaaacaggtctcttgaaaacattgttcagccgcctggagaaatgaatgataggttagatccttcctctttccaaacaaatgatcatccttggacagtccccactgtcttccaacctcaaacatttcaaagaccttctgcagattcactccctaggggttctgctaggttaacaagtcaaaatctgtattctaatgtatttaaacctgctgatgtggtctcacctaaaatccccagtgggtttcctattgaagatcacgaaaccagcccactggataactctgatgcttttctctctactcatttaaagctgttccctagcgcttctagcaattccttctacgagtctgagctaccacaaggtttccaggattattacaatttaggccaattcacagatgacgatcaagtgccaacacccctcgtggcaataacgatcactaggctagtggtgggtttcctgctgccctctgttatcatgatagcctgttacagcttcattgtcttccgaatgcaaaggggccgcttcgccaagtctcagagcaaaacctttcgagtggccgtggtggtggtggctgtctttcttgtctgctggactccataccacatttttggagtcctgtcattgcttactgacccagaaactcccttggggaaaactctgatgtcctgggatcatgtatgcattgctctagcatctgccaatagttgctttaatcccttcctttatgccctcttggggaaagattttaggaagaaagcaaggcagtccattcagggaattctggaggcagccttcagtgaggagctcacacgttccacccactgtccctcaaacaatgtcatttcagaaagaaatagtacaactgtgtga

SEQ ID NO: 40 - protein, 482 aa, Homo sapiens
MASFSAETNSTDLLSQPWNEPPVILSMVILSLTFLLGLPGNGLVLWVAGLKMQRTVNTIWFLHLTLADLLCCLSLPFSLAHLALQGQWPYGRFLCKLIPSIIVLNMFASVFLLTAISLDRCLVVFKPIWCQNHRNVGMACSICGCIWVVAFVMCIPVFVYREIFTTDNHNRCGYKFGLSSSLDYPDFYGDPLENRSLENIVQPPGEMNDRLDPSSFQTNDHPWTVPTVFQPQTFQRPSADSLPRGSARLTSQNLYSNVFKPADVVSPKIPSGFPIEDHETSPLDNSDAFLSTHLKLFPSASSNSFYESELPQGFQDYYNLGQFTDDDQVPTPLVAITITRLVVGFLLPSVIMIACYSFIVFRMQRGRFAKSQSKTFRVAVVVVAVFLVCWTPYHIFGVLSLLTDPETPLGKTLMSWDHVCIALASANSCFNPFLYALLGKDFRKKARQSIQGILEAAFSEELTRSTHCPSNNVISERNSTTV

SEQ ID NO: 41 - DNA, 852 bp, Homo sapiens
  CDS (59)..(463)
cttgcagctgcccacctcaccctcagctctggcctcttactcaccctctaccacagacatggctcagtcactggctctgagcctccttatcctggttctggcctttggcatccccaggacccaaggcagtgatggaggggctcaggactgttgcctcaagtacagccaaaggaagattcccgccaaggttgtccgcagctaccggaagcaggaaccaagcttaggctgctccatcccagctatcctgttcttgccccgcaagcgctctcaggcagagctatgtgcagacccaaaggagctctgggtgcagcagctgatgcagcatctggacaagacaccatccccacagaaaccagcccagggctgcaggaaggacaggggggcctccaagactggcaagaaaggaaagggctccaaaggctgcaagaggactgagcggtcacagacccctaaagggccatagcccagtgagcagcctggagccctggagaccccaccagcctcaccaacgcttgaagcctgaacccaagatgcaagaaggaggctatgctcaggggccctggagcagccaccccatgctggccttgccacactctttctcctgctttaaccaccccatctgcattcccagctctaccctgcatggctgagctgcccacagcaggccaggtccagagagaccgaggagggagagtctcccagggagcatgagaggaggcagcaggactgtccccttgaaggagaatcatcaggaccctggacctgatacggctccccagtacaccccacctcttccttgtaaatatgatttatacctaactgaataaaaagctgttctgtcttcccacccgc

SEQ ID NO: 42 - protein, 134 aa, Homo sapiens
MAQSLALSLLILVLAFGIPRTQGSDGGAQDCCLKYSQRKIPAKVVRSYRKQEPSLGCSIPAILFLPRKRSQAELCADPKELWVQQLMQHLDKTPSPQKPAQGCRKDRGASKTGKKGKGSKGCKRTERSQTPKGP

SEQ ID NO: 43 - DNA, 6788 bp, Homo sapiens
gctttcctctcctttctccctcccccttgtctgcgccacagcccccttctctccccgccccccgggtgtgtcagatttttcagttaataatatcccccgagcttcaaagcgcaggctgtgacagtcatctgtctggacgcgctgggtggatgcggggggctcctgggaactgtgttggagccgagcaagcgctagccaggcgcaagcgcgcacagactgtagccatccgaggacacccccgcccccccggcccacccggagacacccgcgcagaatcgcctccggatcccctgcagtcggcgggaggtaaggagcagggcttgcaaaccgcccggcgcccagggaagcgacgagcgccggggcaaggcaagccctggacgggattgcgacgtgcgcaccgggcgccctaatatgcccgggggactgtttctgcttccgaaacaaaaccatctctgggttttcccagaaaagccagttccagccccgaaggcatcctggctagaggagacccgccctaatccttttgcagcccttaccggggggagtaatggcttctgcgaaaagaaattccctcggctctagaagatctgtctgtgtttgagctgtcggagagccggtgcgtccccaccccaggctggggttcttctccaaagggtgcccctggaggaagaagagggggggattaggcagggcgaggccgccgcggtcgcaatctgggtcacggctgctccagcttggaggagaggcggctctcccggcgacctcctcgcgcgcggcgcccctgccattcccgggaacaggggctcagcctctccctccctggaagaggacgttgtcgtggtttggaagagcaggggtgggcttagagcttccaattaagctattggcaggagtatccctgcagcgggtgaatgccgaggggcgtttgcccaaatttggggaggggaaggatttgtggatatgggtgtctgttgttggtctctgtctagagaaaggcttttttttatttgcaaagttttctaaatcccctgctatcatttgcactcctgaggttgcatttttacaaagggggtagaaggtactccaaataccattcccggtagctgggtcggagagcctggggcttcccctgagcagccggccccacaccgctgcgagtgcggttgtctgcgtgctcgtgagagctagaattctgcagccaggaacagccccctcccccaggcagtgccttgtgtgaatgaaatggcagtttccaaagttgcggacgcctcgccaccaccccctgcatctgcatgccccctcccaccccctgtcgtagacagcttgtacacaaaaggagggcgggagggagggagcgagaggcacaacttcctccaccttcgggagcagtgggcagagtggggggcttggagggaagattggggaacctggttagagggggcgcccattgcctatcccctcggtctgccccgtttgcccaccctctccggtgtgtctgtcggttgcagtgttggaggtcggcgccggcccccgccttccgcgccccccacgggaaggaagcacccccggtattaaaacgaacggggcggaaagaagccctcagtcgccggccgggaggcgagccgatgccgagctgctccacgtccaccatgccgggcatgatctgcaagaacccagacctcgagtttgactcgctacagccctgcttctacccggacgaagatgacttctacttcggcggccccgactcgacccccccgggggaggacatctggaagaagtttgagctgctgcccacgcccccgctgtcgcccagccgtggcttcgcggagcacagctccgagcccccgagctgggtcacggagatgctgcttgagaacgagctgtggggcagcccggccgaggaggacgcgttcggcctggggggactgggtggcctcacccccaacccggtcatcctccaggactgcatgtggagcggcttctccgcccgcgagaagctggagcgcgccgtgagcgagaagctgcagcacggccgcgggccgccaaccgccggttccaccgcccagtccccgggagccggcgccgccagccctgcgggtcgcgggcacggcggggctgcgggagccggccgcgccggggccgccctgcccgccgagctcgcccacccggccgccgagtgcgtggatcccgccgtggtcttcccctttcccgtgaacaagcgcgagccagcgcccgtgcccgcagccccggccagtgccccggcggcgggccctgcggtcgcctcgggggcgggtattgccgccccagccggggccccgggggtcgcccctccgcgcccaggcggccgccagaccagcggcggcgaccacaaggccctcagtacctccggagaggacaccctgagcgattcaggtaaagaccgaactcgggtccggctgcctccctggggcactggaccccgggtcgcgtcccctttgttagtgctcgtatgtcttggcctggggagcattttggaggcagtgctaggggcagagaggtcctgtttcccccaagtctctcctcggggtaaagagaaggggctgagagaatgccgttgcaaaaggggtgctctccaattctcgccttcactaaagttccttccaccctctcctggggagccctcctctaggccatcacgggccctcacccggtcccccacctctcttttgcaggcagtctgaggaataaaattggagaagttggtggctaaaccgggtgggggtttagggggttgctgggtgcactgcctggacagaaacctgattgcgcaggggtgaaagggactctctggcccaggtcaggggagggaaagacatcccgagaagattcaagggctgtgcaaagccctgtttaaggcgcaggaacttataggagggttgcacagatggctagagccgattttctattctttttctttttctttttttttttttttcaaatgtcggtacctttcccttcccccatcctcggtgggtggtgggctatttgctcctgttcgtggccagcaggcggcgatatgcgaggccagcaggcgggcccgggatctgaaaggctgggggtggtgggggcaccctccctccctccattcagcagctggctgcaagtgcaacagcagttgtgtacattctcagggggcctcctctttccagtgtgcagtggaaactggctgtagttttgtcttccagcctgaattccaggcctaatttgagatgtgagttgtatctaacccagtgcccttgaaggtgagggcaggcactcagcagcctctccaggaaggctcacatcctgggaggactcactgattagttctattgtgttcatttgtctgtgtcttaagctgaagggaagagttaaaaccaagcctttccctgggggtctggatgaacagaactcaacccaaagagtggcattgccttgtccttggagcagggagctgggaccccccttggactttgaaaacagtgttttcagaatgcaggtggataacaagcctaaatttacttctgggctgaggagagatctttgaggctcctggaaggaaacttggtgataagcctccagtttgaaacggctctgtccctttaatgtctgtgccttgacagcttttggtgaggaagcacttccttccaacagctgtcttcttggcagaaaaccaaaacattggcttaaagggacccacagactggaacagcctcacatttcggctttagaacaaatcccacaattgttcagctttccggtccccttcagatcaagcagaagatatgttttgattttcatgcttgtattttaaacaataattttctaccccagcgtggtagtcaatgaggagagaggggaagaatgcgcacatgatgctacacgtttctgttgttgctgttattattggtggctttgaggagagctgctcccatttggggtttataccaactgtggattatggctttgtcattaagatttgatctttgttaaatgaaaaactgtttattgtataaaactcaggtttgtggacgaaaagttgttttttttcttcagttaattaaattgttcctcaagtttgtttaaggacttaaaatcaaacacaaccatgtgtaaactgctaaatgaggctcctaaaatgagaggcctcaactctttaagtgtggagctagaaatgtaaataagtccacagggcagactggtgattatgataaaagctaccatttactgagcatctgtctactaggctcagctctatgctaagtctacatgttatctgtcaaagtggtatcatccccatttaatagctgaggaaacagaggcttagaaaggctgggtaacttgaccagggtcatgcaactagtctgcggtggagccaggattctgtctgaccctaaaggccaaggttctttatatttatttctaccacctgctaaagtcttgaatggaggctgaaagcacagttggggtatggggaaagaaaatatatatacatacatatatgtatatgtatgtatgtatgtatggggggttgttttgtttttgtttttgataaggagttttgctcttgttgcccaggctggagtgcagtggtatgatctgggctcactgcaacctccgccacccgggttcaagtcattctcctgcctcagcctcccgagtagctgggattaccggagcatgccaccacacccagcaaagttttgtatttttagtagagacagggtttcaccatgttggccaggctgatcttgaactcctcatctcaggtgatctgccgcctccgcttcccaaagtgctgggattacaggtgtgagtcaccgcgtccggcctacagatatatttaatttaaagatctaaaacaaatacaaaactgtccacatctatgttgatggacccataaaaatagcagtctgccagggtctgccggaagagacagataagcatacatattaacatggatatatatgtgaatttcattcaaatggttctcacatgagagtaactagcatctttctctcagatgatgaagatgatgaagaggaagatgaagaggaagaaatcgacgtggtcactgtggagaagcggcgttcctcctccaacaccaaggctgtcaccacattcaccatcactgtgcgtcccaagaacgcagccctgggtcccgggagggctcagtccagcgagctgatcctcaaacgatgccttcccatccaccagcagcacaactatgccgccccctctccctacgtggagagtgaggatgcacccccacagaagaagataaagagcgaggcgtccccacgtccgctcaagagtgtcatccccccaaaggctaagagcttgagcccccgaaactctgactcggaggacagtgagcgtcgcagaaaccacaacatcctggagcgccagcgccgcaacgaccttcggtccagctttctcacgctcagggaccacgtgccggagttggtaaagaatgagaaggccgccaaggtggtcattttgaaaaaggccactgagtatgtccactccctccaggccgaggagcaccagcttttgctggaaaaggaaaaattgcaggcaagacagcagcagttgctaaagaaaattgaacacgctcggacttgctagacgcttctcaaaactggacagtcactgccactttgcacattttgattttttttttaaacaaacattgtgttgacattaagaatgttggtttactttcaaatcggtcccctgtcgagttcggctctgggtgggcagtaggaccaccagtgtggggttctgctgggaccttggagagcctgcatcccaggatgctgggtgccctgcagcctcctccacctcacctccatgacagcgctaaacgttggtgacggttgggagcctctggggctgttgaagtcaccttgtgtgttccaagtttccaaacaacagaaagtcattccttctttttaaaatggtgcttaagttccagcagatgccacataaggggtttgccatttgatacccctggggaacatttctgtaaataccattgacacatccgccttttgtatacatcctgggtaatgagaggtggcttttgcggccagtattagactggaagttcatacctaagtactgtaataatacctcaatgtttgaggagcatgttttgtatacaaatatattgttaatctctgttatgtactgtactaattcttacactgcctgtatactttagtatgacgctgatacataactaaatttgatacttatattttcgtatgaaaatgagttgtgaaagttttgagtagatattactttatcactttttgaactaagaaacttttgtaaagaaatttactatatatatatgcctttttcctagcctgtttcttcctgttcatgtatttgttcatgtttggtgcatagaactgggtaaatgcaaagttctgtgtttaatttcttcaaaatgtatatatttagtgctgcatcttatagcactttgaaatacctcatgtttatgaaaataaatagcttaaaattaaatgatgcaactcaaccttttccttaatggcattacactctgcccttaaggagcaaccataaataatccataacctatagagggaatttggtttccgtaaatagccctttttgcacctgtacaatcctggttggggggcatgagtcatgtccccacttaaggtggagggaactgagtttggggaaattaaggcagttctccaagattatgcagaatagagatgttattagcgact

SEQ ID NO: 44 - DNA, 6107 bp, Staphylococcus aureus
  CDS (2507)..(3778)
  CDS (3813)..(4529)
agatctatcaaggatgtgatgttatgaaagtccaaatttatcaattaccgattgtttttggagatagttctaaaaatgaaactcaaataacgcaatggttcgaaaaaaatatgaatgctgaagtagatgtagtcgttttacctgaaatgtggaataatggctatgatttagagcatttaaatgaaaaagcagataataatctaggacaaagtttttcatttattaaacatttagctgaaaaatataaagtcgatatcgtagctgggtctgtttctaacattagaaacaatcaaatatttaatacagcttttagtgtgaataaaagtggccagctgattaatgaatacgacaaagttcatttagttcctatgttaagagagcatgaatttttaaccgctggcgaatacgtagctgaaccctttcaattgtctgacggtacttatgtgacccaacttatctgttatgatttacgttttccagaattattaagatatcctgctcgtagtggtgctaaaattgcattttatgtggcgcaatggcctatgtcacgtcttcaacattggcattcattactaaaggcacgtgcaattgaaaataatatgtttgtcattggaactaatagcactggattcgatggtaacacagaatatgctggtcattcgatagttataaacccaaatggagatttagttggagaattaaatgaatccgcagatattttgactgtagatttaaacttaaatgaagtagaacagcaacgcgaaaatatacctgtatttaaaagtattaaattagatttgtataaataagaagcgcccgaaataatatttaacacatgtcatgactaaacatagatttatgagagatttttcataagtctatgtttatttttttataatagataactcagtaagaacccatttcgccctttgcaaatgaatgattttcttaattaaattgattaattttttgaccttttccaacattagacttattcatatattttaacggcgggtctcataatgatgattaactcatcccttcttcattacaaaaaaggccgcgagcttgggaggggctcacgaccatacttattattaagggaatgttttacagttattttttcaatctatttttggggatgttattaattatgaaaaaaattttatttatcaaataatgataaatcgatgttgtttacgatagcttacatgctagaaataattatctgtaatgataattaagaaaaatacatagcactgagtccaaggaaactaactctactagcaaatgttactcacttgctaattttacatggttattaagttgggatggcttaataactcatacttttagtactatacgaagataacaaatttacaatgaaagtaattaattattcatcttattttttagtgaatttgttcactgtgtcgataatccattttactaagtcaccgattgttgaaatgatatcttgtgccattgaaatcactccttccttaattaagataaaaattcttaaaattaaacaactcatcaactattttccatcacatctctgtgatctagttatattaaaacatgctaaaagcatttattttccaatttttcttaactagtcgttttttattcttaactgtaaatttttttatgttaaaatattaaatacaaattacatttaacagttaagtatttatttcctacagttaggcaatataatgataaaagattgtactaaatcgtataatgacagtgaggagagtggtgtaaaattgaattattttgataataaaattgaccagtttgccacgtatcttcaaaagagaaataacttagatcatattcaatttttgcaagtacgattagggatgcaggtcttagctaaaaatataggtaaattaattgttatgtatactattgcctatattttaaacatttttctgtttacgttaattacgaatttaacattttatttaataagaagacatgcacatggtgcacatgcaccttcttctttttggtgttatgtagaaagtattatactatttatacttttacctttagtaatagtaaattttcatattaactttttaattatgattattttaacagttatttctttaggtgtaatctcagtatatgctcctgcagcaactaaaaagaagcccattcctgtgcgacttattaaacgaaaaaaatattatgcgattattgttagtttaacccttttcattatcacacttatcatcaaagagccatttgcccaattcattcaattaggcatcataatagaagctattacattattacctattttctttattaaggaggacttaaaatgaatacattatttaacttattttttgattttattactgggattttaaaaaacattggtaacatcgcagcttatagtacttgtgacttcataatggatgaagttgaagtaccaaaagaattaacacaattacacgaataatttaaatagagagtgtgatagtaggtggaattattaaatagttataattttgttttattcgtattaactcaaatgatattaatgtttacaataccagctataattagtggtattaagtacagtaaacttgattattttttcatcatagtaatttcgacattatcgttatttctatttaaaatgtttgatagcgcgtccttaatcatattaacttcatttattattataatgtattttgtcaaaatcaaatggtattctattttgttgattatgacttcgcagattattctatactgtgctaactacatgtatatagttatatatgcatatatcaccaaaatttctgatagtatatttgtaatattccctagcttttttgtagtttatgtgactattagtatactattctcatatataataaatagagttctcaaaaaaattagcacaccatatctaatactaaacaaaggatttttaatagttatttcgactatcttactgcttactttttcattatttttcttttattcacaaataaactcggatgaagctaaagtaataaggcagtattctttattttattggtatcactatattttaagtatattaacattgtattctcaatttctccttaaagagatgaaatataaacgtaatcaagaagaaattgaaacctattatgaatatacattgaagattgaagctatcaacaacgaaatgcgcaagttccgtcatgattatgtcaatatcttaacgacactttcagaatacattcgagaagatgacatgcctggcctacgtgattatttcaataaaaatattgtacctatgaaagacaatttacaaatgaatgctataaaattaaatggtatcgagaatcttaaagtacgtgaaattaaaggcttaattactgcgaaaattttacgtgcacaagaaatgaatattccgattagtatcgaaatacccgatgaagtaagtagcattaacttgaatatgatcgatttaagtcgcagtattggtattattcttgataatgcaattgaggcatcaactgaaattgatgaccctatcattcgcgttgcatttattgaaagtgaaaattcagtaacgtttattgttatgaataaatgcgctgatgatataccacgcattcatgaattgttccaagaaagtttttctactaaaggtgaaggtcgtggtttaggtctatcaactttaaaagaaattgctgataatgcagacaatgtcttattagatacaattatcgaaaatggtttcttttattcaaaaagttgaaattattaacaactagccataaggatgtgaatgtatgaaaattttcatttgcgaagacgatccaaaacaaagagaaaacatggttaccattattaaaaattatataatgatagaagaaaagcctatggaaattgccctcgcaactgataatccttatgaggtgcttgagcaagctaaaaatatgaatgacataggctgttactttttagatattcaactttcaactgatattaatggtatcaaattaggcagtgaaattcgtaagcatgacccagttggtaacattattttcgttacgagtcacagtgaacttacctatttaacatttgtctacaaagttgcagcgatggattttatttttaaagatgatccagctgaattaagaactcgaattatagactgtttagaaactgcacatacacgcttacaattgttgtctaaagataatagcgttgaaacgattgaattaaaacgtggcagtaattcagtgtatgttcaatatgatgatattatgttttttgaatcatcaacaaaatctcacagactcattgcccatttagataaccgtcaaattgaattttatggtaatttaaaagaactgagtcaattagatgatcgtttctttagatgtcataatagctttgtcgtcaatcgccataatattgaatctatagattcgaaagagcgaattgtctattttaaaaataaagaacactgctatgcatcggtgagaaacgttaaaaaaatataataagataataaagtcagttaacgacgtattcaattgtaaatcttgttggattttaacaagataactagcaaatgcactgtatagctggctttttaattttattaacaaaattaaatatgacgcgtgaattaaaaaatgatgtaacgtctctttgtatacctattcctattactacataatttatcaatttctatttcactctacaatcctatggcgcaatttttaacaaaatatactaaatttgaaattgacagtttccataaataaaatgctataatttcctactccgtgaatcttattttgtttaaaaaaacagtgtagcacaagattcaacttgtttcctacactgttttataaatgaattatttaaaatgcttgttcaacctcttgtaatgttggcaaactattaatagcaccatacttcgttgtcactattgcagcaacgcgattgctaaacgctaaaatttcctcaccttcattttcaaataactgagttaaatttaacacatcggttgctaaaatcctgctaataactgcaccaataaatgcatcccctgccccagttgtatcaacaggttttaccttatagccactatgataatgattaataccatttttcaaatatacggcagcaccatctgctcccttcgtataaatgactacagtaacattacctgtaaataatgattgaatggcttcattttcatcatgaatacctgtaataaattctaattcttcatctgaaacttttacaatatgcgccaatggcaaaaaggtatgaatagtttgtcttaaatcttcagcgttatcccataatggcaatcttacattaggatcaaatacgacagtaccatttgcatttaatgttttggtaatcaattgataatgtgcatctctcatcggactatcgaccaaatcaacagaacaaaaatgtactacatcattttcattcacatcaatatcattcacaaaacttggttcaaataacatatcagcagagggcttacgataaaaagaaaaatctcgctcgcccgcttcagtcaaactcacaaaagctaacgcagtgtttgcttcattcgtgcgatacacttttgatacatctacaccaatacttgatatcgtttcaataatgctatctccaaatgcatcattacctaattgtgtaatcatatacgcttgttgtcctaacttttgaactgtacaagctacattgcatggcgcgccaccaatttgcttcgtaaatgtttgaacatcttttaaattcgcatttgtaacatttggaataaaatcaattaacgcttctcctattgaaaatagacgtctcatttatgttcatcctttaaatcatatttagtaaattgtaaatatacttgccctgattctgttgatgttttaatacctagtgcgtcttctgtcgggaaaattcgagatgtcaaaacacgttctccatcattacagaaaatttctatactagatgtatcaacaaaaatttgtaattgctttaatggcgtgtctaatatcgtactacgcgtcgtaccttcaacatttgtcggcaataaaccactgtcgctgcgatcc

SEQ ID NO: 45 - protein, 423 aa, Staphylococcus aureus
VELLNSYNFVLFVLTQMILMFTIPAIISGIKYSKLDYFFIIVISTLSLFLFKMFDSASLIILTSFIIIMYFVKIKWYSILLIMTSQIILYCANYMYIVIYAYITKISDSIFVIFPSFFVVYVTISILFSYIINRVLKKISTPYLILNKGFLIVISTILLLTFSLFFFYSQINSDEAKVIRQYSLFYWYHYILSILTLYSQFLLKEMKYKRNQEEIETYYEYTLKIEAINNEMRKFRHDYVNILTTLSEYIREDDMPGLRDYFNKNIVPMKDNLQMNAIKLNGIENLKVREIKGLITAKILRAQEMNIPISIEIPDEVSSINLNMIDLSRSIGIILDNAIEASTEIDDPIIRVAFIESENSVTFIVMNKCADDIPRIHELFQESFSTKGEGRGLGLSTLKEIADNADNVLLDTIIENGFFYSKS

SEQ ID NO: 46 - protein, 238 aa, Staphylococcus aureus
MKIFICEDDPKQRENMVTIIKNYIMIEEKPMEIALATDNPYEVLEQAKNMNDIGCYFLDIQLSTDINGIKLGSEIRKHDPVGNIIFVTSHSELTYLTFVYKVAAMDFIFKDDPAELRTRIIDCLETAHTRLQLLSKDNSVETIELKRGSNSVYVQYDDIMFFESSTKSHRLIAHLDNRQIEFYGNLKELSQLDDRFFRCHNSFVVNRHNIESIDSKERIVYFKNKEHCYASVRNVKKI

SEQ ID NO: 47 - DNA, 7499 bp, Escherichia coli
  CDS (444)..(1475)
  CDS (1478)..(2590)
  CDS (2592)..(3386)
  CDS (3426)..(4361)
  CDS (4375)..(5481)
  CDS (5484)..(6503)
  CDS (6543)..(7487)
atagtaaatagctgacttatggatgtgctggggattctatgtatttagctgtggctttaccattacttttcccgtttttgacttaaatagcttcagtttggtctgatctgccgctacatcttcattttttttgtatttttatgcgattcattgaaactcggccccattttcaaatctacataggccgtactgacattatcgaaatgctattttttatctatttgatttttatgattaaagtatattttgtgtataaaaatcattcgggtcggattgctgcgaaagaaatgatacactagcacgtcaaagtaagtgcgttatcagtattcaggtagctgttgagcctggggcggtagcgtgcttttttctgcttaacttaaccagacaatcacacaaaagagtcgctagtggaaaagccatttcgaaaaatcctggtcataaagatgcgatatcatggggatatgttattaactactcctgtcatcagtacgctcaagcagaattatcctgatgcaaaaatcgatatgctgctttatcaggacaccatccctattttgtctgaaaacccggaaattaatgcgctctatgggataagcaataaaggtgcgggaactttcgataaaattaaaaatgtgctttcgttgataaaaactctgcgtgcgaataattatgacctggtcattaatcttacggatcagtggatggtggcgctgctggtacgttgtttacctgcacggatgaaaatatcgcaactttatggtcatcggcagcatggtatttggaaaaaaagcttcacacacttagcgccaatacacggtacacatattgttgagcgtaatttatcggtccttgagccattaggtattaccgatttctacaccgacacaacaatgagttacgccgaagattgctggaagaagatgcgccgggaattagatgccctgggcgtaaaagatcattatgttgtcatccaaccgacagcgcgtcagatatttaagtgttgggataacgataaattttctaaggttatcgatgcgctgcaacagcgaggctatcaggttgtgctaacctgtgggccctcggcagatgatctcgcttgtgtagatgagattgcacgaggttgcgaaacaaaacccattactggccttgcaggtaaaacacgttttcctgaactgggtgcattaattgatcatgcagtgctttttattggtgtggattctgcgccgggacatattgcagcggcagtgaaaacgccagtcattagtctatttggtgcaacggatcacgtattctggcgtccctggaccgagaatattattcaattctgggcggggaattatcagaaaatgccgacccggcatgaacttgaccgcaacaaaaaatatctttctgttatcccagcggaggatgtgatcgccgctacggaaaagctgttgccagaagatgccccttcagctgacaggaatgcacaattatgatcgtggcgttttgtttatataaatattttccatttggtgggcttcaacgtgactttatgcgcattgcatcaacagttgccgcacggggccaccatgttcgggtatatacacagtcgtgggaaggcgattgcccgaaagcatttgagcttattcaggtgccagttaagtcccataccaaccatggacgcaatgcagaatattatgcctgggtacaaaatcatctcaaagagcatcccgcagatcgcgttgttgggtttaataagatgcctggcctggatgtttattttgccgctgatgtttgttacgccgagaaagttgcgcaagaaaaaggttttttatatcgtttaacatcacgatatcgccattatgccgcatttgagcgagcgactttcgagcagggtaaatcgacgaaacttatgatgctgaccgataagcaaatcgccgatttccagaagcattatcaaactgaacctgaacgttttcaaattcttcctcccggtatttatccggacagaaaatacagtgagcaaatcccaaacagccgtgaaatttatcgccagaaaaatggcataaaagagcaacaaaacttattactgcaggttggatcagattttggccgtaaaggtgtagatcgctcaattgaagctttggcatcgttaccggaatcattacgtcacaatacgcttttatttgttgttggtcaggataagccgcgaaaatttgaagcgctggcagaaaaactcggcgtgcggagcaatgtgcatttcttctccggtcgcaatgatgtgtcagaattaatggcagccgctgatttattactgcatcccgcttatcaggaagccgcgggtatcgttcttctagaagcgatcactgctgggttacctgttttaacaacagcggtatgtgggtacgcgcattatattgcggatgccaattgtggaacggtcatcgctgaacctttctctcaggaacaattaaatgaagttttacgtaaagcgttaactcagtcgccattgcgaatggcctgggcggagaatgctcgccattatgccgatactcaggatttgtatagcttgccagaaaaagccgcggatatcattacaggtggtttagatggttgaattaaaagagccgcttgccacactttggcgtggtaaagatgcttttgcagaggtcaaaaaactgaacggcgaggtctttcgtgaactggagactcgtcgtacattacgctttgaactgtccgggaaaagctattttcttaaatggcacaaggggacgacattaaaagagattataaaaaatctactctcattgcggatgcccgttttgggcgcagacagagagtggcacgctattcatcgcctgagtgatgttggcgttgatacaatgaagggcattgggtttggcgaaaaagggttaaatccattaactcgcgcatcatttattattaccgaagatctcactcccacaattagccttgaagattattgtgccgattgggcagtcaacccgcctgatatacgtgttaagcgtatgctgatcgcacgtgtagcaactatggtgcgtaaaatgcatactgcagggataaatcaccgcgactgttacatttgccactttttgcttcatttgccatttactggccgggaagatgaattaaaaatttcagttatcgatctgcatcgggcacagatacgtgcaaaagtaccgcgccgctggcgcgataaagacctgattggtttatatttctcatcaatgaatattggcctgacgcaaagagatatctggcgatttatgaaggtttattttgggatgcctttacgcaaaatattgtctcttgaacagaatttattgaacatggcaagcgttaaggccgagcgtattaaagagcgaacacaacgcaaaggattataaaaatatttattagtatgtactggaactaactttattatgactatttattttataaattgggttgcagattatgaattaaaaatgattcagtacctgaaaaaaaagtacaagataaaaaatataacaacaccaaaaaaatataactggattaataaaaaaatatcaaaaatagggatggataatgcatggctggggcgattattcatcaagcattacctcaatgatattaaaaaagatgacataattatcattaatgacagtgttgttaataaaggtatcaataaacaaatattaaaaaatattaactgtcataaagttttgcttctaagaaatactgttggcgaagattttattcttgataacgcgaattatttcgatattatatatgattttgagcatagatttatagggaatgaaaagatcaaggcaatagaacaattttttcctataggaatggatgaaattagaaattatagtttatctgacaaaaataacagccagccaatatgttttttccttggtcgtgataaagggcgtcttcaaataattaatgagttagccgagagattaacaacactaggatgtaagctagattttaatgttgtcaaagataagacatcatctacgacttcaaagtatttgattgaaaaacaaatatcttatgaagagaatattagaagaacattaaatgctaatataattgttgatataaccaaagaaaaccaatctggctggactcttcgtatacttgaggcactatttttcaataaaaaattaattactaataatataaatgtatttggttcagaaatctatagtgaatctcgcttttttataataggtcatgatgattgggataagttagagtattttattaactcatctgttaaaccaatggattatgatagtttatataaattcagtccagataaaatgatgtcaacgattgtttctgattttatagacaaataaaaccgttaaaacagtgagttttactcaattaatgagagtttctatgaaaatagcgtttatcggcgaagctgtttctggatttggcggcatggaaactgtcatccgtgatgttattactaccttcaggcaacaacatatccaaagtgaaatgtttttcttttgtcgtaatgacaaaatggataagggatggctggaaggtattaaatactcatgttcattttccaatattcgtttaggttttttgcgtcgggcgaaacatattcatgctctaagtaaatggcttcaggagtaccaaccagatatcgttatttgtattgatgtgatctcctgcctgtttgccgcaaaagcacgtaaaaaatcaggaattgatatgccagtattttcatggccacatttttctttagatcacaaaaaacatgctgaatatatcacctgtgccgactatcatttagcaatcagctctggcattaaacagcaaatgattaatcgaggtgtagcagaatcgacgataaatgttatttttaatcccgtcgaaactaaagactcagtcattcccgcgcccgaggaaggtgaaacggcaacgtttatttatgttgggcgtatgaaatttgaaggccagaaaagagttaaagacctgcttgatggcttatcacaagcgaaaggtaactggaaactccatgtattgggtgatggctccgatttcgaaaaatgccaggcttatggtagagaattaaatattgatgatcgaattgtctggtatggttggcaacaatatccctgggaattggtccagcaagatattgaaaaagtgagtgcgttattgctcacgtcatcttttgaaggtttcccaatgaccctacttgaagccttgtcgtgggggattccttgtatcagtgccgattgtgtctccgggcctgctgacattattcaacctgatgtcaatggccatctgtatcaaccgggagatattgctggttttgtaactcttctaaataaatatatagcaggtgaaattcatatcgaacatgaaaaaattcctgcgtcgatcgatgaattttaccaatcgaagtattacgatagattacataaggtaattatttctgctatttcccggaggaaataatgcagcaggtgtttttccaggaaactgagtttcttaattcagttattgattatgatcataaagtagaaacagaaaatctttgtctggacatcgcttatggaactgacaaaaactttctatttggttgcggaatttcgattgcttcaatattaaaatataatgaaggaagtcgattgtgtttccatatttttactgattattttggtgatgatgatcgtaagtattttgatgccctggcgttgcagtataaaaccagaattaaaatatatctgattaatggtgatcgactgcgctcattgcctagcactaagaattggactcatgcaatatattttcgttttgttattgcagattactttattaataaggcgcctaaagtcctttatctggatgcagatatcatttgtcaggggactattgagccactaattaatttctcatttcctgacgataaagtcgcaatggttgttacagaagggcaagctgactggtgggaaaaacgcgcccattcgttaggtgttgcgggaattgctaaaggttactttaactccggttttttattgattaatactgcccaatgggcggctcagcaggtttctgcacgagctattgcaatgctaaatgagccagaaataatcaaaaaaataacacatcctgatcaggatgtgttaaatatgttgctggcggataaacttattttcgctgatattaaatataacacccagttcagcttaaattatcaactcaaagaaagctttataaacccagtaaccaacgatactatttttatccattatatcgggccaaccaagccctggcatgattgggcctgggattatcctgtatcacaagcctttatggaggcaaaaaatgcttcgccatggaagaatacggcgttgctgaaaccgaacaatagcaatcaattaagatatagcgcaaaacatatgcttaaaaagcatagatatctaaaaggatttagcaactatcttttttattttattgaaaagataaagcattaaaactgggaaactataaagtaatgatataagggtagcattgtggactcatttcctgccatagagatagataaagttaaagcctgggattttcggctagctaatataaatacttctgaatgtttaaatgttgcctatggtgtcgatgctaattatcttgatggtgtaggtgtttccatcacatcaattgtcctaaataatcgacatattaatcttgatttttatattattgctgatgtttataatgatggtttttttcaaaaaattgcaaagcttgcagagcaaaaccaattaagaatcacgttatatagaattaacactgataagctccagtgcttgccttgtacacaggtctggtcaagagcaatgtacttccgtttatttgcatttcaattattgggtttaacgcttgatcgtttgctttatcttgatgcagatgttgtttgtaaaggcgatattagccaactattacatctgggtttaaatggagcggttgctgctgttgttaaagatgttgagccaatgcaagaaaaggcggtatccaggttgtctgatcctgaattacttgggcagtactttaattccggtgtcgtttatttagacttaaaaaaatgggctgacgcaaaactaacagaaaaagcgttgtctattcttatgagtaaagataatgtttataaataccctgatcaggatgttatgaatgtcttactgaaagggatgacattatttttgcctcgtgagtacaatacaatttatacaattaaaagtgaattaaaagacaaaacacatcaaaactataaaaagctgattacagaaagtactcttcttattcattatacaggtgcaactaaaccgtggcacaaatgggcaatttatccatcggtaaaatactataaaatagctttagaaaattccccctggaaagatgactctccacgagatgcgaaatcaattattgaatttaaaaaagatataaacatcttttagtgcaacatcatt

SEQ ID NO: 48 - protein, 344 aa, Escherichia coli
MRYHGDMLLTTPVISTLKQNYPDAKIDMLLYQDTIPILSENPEINALYGISNKGAGTFDKIKNVLSLIKTLRANNYDLVINLTDQWMVALLVRCLPARMKISQLYGHRQHGIWKKSFTHLAPIHGTHIVERNLSVLEPLGITDFYTDTTMSYAEDCWKKMRRELDALGVKDHYVVIQPTARQIFKCWDNDKFSKVIDALQQRGYQVVLTCGPSADDLACVDEIARGCETKPITGLAGKTRFPELGALIDHAVLFIGVDSAPGHIAAAVKTPVISLFGATDHVFWRPWTENIIQFWAGNYQKMPTRHELDRNKKYLSVIPAEDVIAATEKLLPEDAPSADRNAQL

SEQ ID NO: 49 - protein, 371 aa, Escherichia coli
IVAFCLYKYFPFGGLQRDFMRIASTVAARGHHVRVYTQSWEGDCPKAFELIQVPVKSHTNHGRNAEYYAWVQNHLKEHPADRVVGFNKMPGLDVYFAADVCYAEKVAQEKGFLYRLTSRYRHYAAFERATFEQGKSTKLMMLTDKQIADFQKHYQTEPERFQILPPGIYPDRKYSEQIPNSREIYRQKNGIKEQQNLLLQVGSDFGRKGVDRSIEALASLPESLRHNTLLFVVGQDKPRKFEALAEKLGVRSNVHFFSGRNDVSELMAAADLLLHPAYQEAAGIVLLEAITAGLPVLTTAVCGYAHYIADANCGTVIAEPFSQEQLNEVLRKALTQSPLRMAWAENARHYADTQDLYSLPEKAADIITGGL

SEQ ID NO: 50 - protein, 265 aa, Escherichia coli
MVELKEPLATLWRGKDAFAEVKKLNGEVFRELETRRTLRFELSGKSYFLKWHKGTTLKEIIKNLLSLRMPVLGADREWHAIHRLSDVGVDTMKGIGFGEKGLNPLTRASFIITEDLTPTISLEDYCADWAVNPPDIRVKRMLIARVATMVRKMHTAGINHRDCYICHFLLHLPFTGREDELKISVIDLHRAQIRAKVPRRWRDKDLIGLYFSSMNIGLTQRDIWRFMKVYFGMPLRKILSLEQNLLNMASVKAERIKERTQRKGL

SEQ ID NO: 51 - protein, 311 aa, Escherichia coli
MTIYFINWVADYELKMIQYLKKKYKIKNITTPKKYNWINKKISKIGMDNAWLGRLFIKHYLNDIKKDDIIIINDSVVNKGINKQILKNINCHKVLLLRNTVGEDFILDNANYFDIIYDFEHRFIGNEKIKAIEQFFPIGMDEIRNYSLSDKNNSQPICFFLGRDKGRLQIINELAERLTTLGCKLDFNVVKDKTSSTTSKYLIEKQISYEENIRRTLNANIIVDITKENQSGWTLRILEALFFNKKLITNNINVFGSEIYSESRFFIIGHDDWDKLEYFINSSVKPMDYDSLYKFSPDKMMSTIVSDFIDK

SEQ ID NO: 52 - protein, 369 aa, Escherichia coli
VSFTQLMRVSMKIAFIGEAVSGFGGMETVIRDVITTFRQQHIQSEMFFFCRNDKMDKGWLEGIKYSCSFSNIRLGFLRRAKHIHALSKWLQEYQPDIVICIDVISCLFAAKARKKSGIDMPVFSWPHFSLDHKKHAEYITCADYHLAISSGIKQQMINRGVAESTINVIFNPVETKDSVIPAPEEGETATFIYVGRMKFEGQKRVKDLLDGLSQAKGNWKLHVLGDGSDFEKCQAYGRELNIDDRIVWYGWQQYPWELVQQDIEKVSALLLTSSFEGFPMTLLEALSWGIPCISADCVSGPADIIQPDVNGHLYQPGDIAGFVTLLNKYIAGEIHIEHEKIPASIDEFYQSKYYDRLHKVIISAISRRK

SEQ ID NO: 53 - protein, 339 aa, Escherichia coli
MQQVFFQETEFLNSVIDYDHKVETENLCLDIAYGTDKNFLFGCGISIASILKYNEGSRLCFHIFTDYFGDDDRKYFDALALQYKTRIKIYLINGDRLRSLPSTKNWTHAIYFRFVIADYFINKAPKVLYLDADIICQGTIEPLINFSFPDDKVAMVVTEGQADWWEKRAHSLGVAGIAKGYFNSGFLLINTAQWAAQQVSARAIAMLNEPEIIKKITHPDQDVLNMLLADKLIFADIKYNTQFSLNYQLKESFINPVTNDTIFIHYIGPTKPWHDWAWDYPVSQAFMEAKNASPWKNTALLKPNNSNQLRYSAKHMLKKHRYLKGFSNYLFYFIEKIKH

SEQ ID NO: 54 - protein, 314 aa, Escherichia coli
VDSFPAIEIDKVKAWDFRLANINTSECLNVAYGVDANYLDGVGVSITSIVLNNRHINLDFYIIADVYNDGFFQKIAKLAEQNQLRITLYRINTDKLQCLPCTQVWSRAMYFRLFAFQLLGLTLDRLLYLDADVVCKGDISQLLHLGLNGAVAAVVKDVEPMQEKAVSRLSDPELLGQYFNSGVVYLDLKKWADAKLTEKALSILMSKDNVYKYPDQDVMNVLLKGMTLFLPREYNTIYTIKSELKDKTHQNYKKLITESTLLIHYTGATKPWHKWAIYPSVKYYKIALENSPWKDDSPRDAKSIIEFKKDINIF

SEQ ID NO: 55 - DNA, 8391 bp, Mycobacterium bovis
  CDS (1)..(8391)
atgggtacgcgcactggcggccgaggacccggttccgtccgacaagcacctgacgtcggccgccgtgtcggtgcccggcgtgttgcttacccagatcgcggcgacccgggcgctggcccgtcaaggcatggacctcgtggccaccccgccggtcgccatggcgggcattcgcaaggtgtgctggcggtggaagccctcaaggctggtggggcacgcgacgtcgagctgtttgccttggcccagttgatcggtgccgccggaacgctggtggcccgccggcgcgaatttccgtcctgggcgatcgcgccgatggtatcggtcaccaacgccgaccccgagcgcatcggccggttgctcgacgagttcgcccaggacgtgcgcacggtgctgccaccggtgttgtccatccgcaacggccggcgtgccgtcgtcatcaccggcacccccgagcagctgtcgcgtttcgagctttattgccgccagatctccgagaaggaagaagccgaccgcaagaacaaggtccgcggcggcgacgtcttctcgccggtcttcgagccggtgcaggtggaggtgggctttcacaccccgcggctatccgacgggatcgacatcgtcgcgggctgggccgagaaggcgggcctcgatgtcgccttggctcgggagctggccgatgccatcttgatcagaaaggtcgactgggtcgacgagatcacccgtgtccaccgggccggcgcccgctggatcctcgacctggggccgggcgacatcctgacccgactgaccgcaccggtgatccgcggcctgggcatcggcatcgtgccggcgcgtacccgcggtggccagcgcaacctgttcaccgtcggcgccacccccgaggttgcccgggcctggtcgagctacgcaccgaccgtggttcgcctccccgacggcagggtcaagctctcgacgaagttcacccggctgacccgccgctcgccgatcctgctcgcgggcatgaccccgaccaccgtggacgccaagatcgtcgccgcggcggccaacggccggcactgggccgagctggcggcgcggggcaggtcaccgaagagatcttcggtaaccgcatcgaacaaatggccggcctgctcgagccgggccgcacctatcagttcaacgcgctgttcctcgatccctacctgtgaagcttcaggtgggcggcaagcggttggtgcagaaggcccgccagtccggcgccgcgatcgacggcgtggtgatcagcgccggcatcccagacctcgacgaggccgtcgagctgatcgacgaactgggcgacatcggcatcagccacgtcgtgttcaaacccgggaccatcgagcagatccgctcggtgattcgcatcgccaccgaggtgcccaccaagccggtgatcatgcacgtcgagggccgggcgcgccggcgggcaccattcctgggaggatctcacacctgctgctggctacctactcggcagatcgggcaccgcgccaacatcacgtgtgcgtcggcggcggccatctcggcaccccgaagaagggctgcggatatttgtccgggcctgggcgcagcgtacggcttcccattgatgccgatcgacgcatcctggtcggcaccgcggcgatggccaccaaggaatccaccacgtcgccatcggtcaagcggatgctcgtcgacactcagggcaccgaccaatggatcagcgccggaaaagcgcagggccgcatgcctccagccgagtcagctcggtgccgacatccacgagatcgacacagcgcatccgtgcggcgctgctcgacgaggtggccggtgacgcggaggcggtcgcggagcgtcgcatggccaagaccgccaagccctacttgccgacgtcgccgacatgacctacctgcagtggctgcgggcgctacgtcgaactggccatcggggaaggcaactcgaccgccgacaccgcctcggtgggcagcccgtggctggccgacactggcgggaccgcttcgagcagatgctgcagcgtgccgaagcccggttgcacccacaggatttcggcccgatccagacgctattcaccgatgctggcctgctggacaatccgcagcagcgatcgccgccctcgtggcgcgctaccccgacgccgagaccgtgcagttgcatcccgcggatgtgccctttttcgtgacgttgtgcaagacgctgggcaagccggtcaacttcgtgccggcgatcgacctcgtcgtgcgcgctggtggcgcagcgactcgctgtggcaggcccacgacgcccgctacgacgccgatgcggtgtgcatcattccgggcacgcgtcggtagccgcatcacccggatggatgaacccgtcggtgagttgctggacgctttcgagcaagccgcaatcgatgaagtgctcggcgccggtgtcgagccgaaggatgtcgcgtccggccggctgggccgggccgacgtggccggaccgttggctgtcgtcctcgacgcacccgatgtgcgctgggccggtcgcaccgtgaccaacccggtgcatcggatccgcgacccggccgaatggcaggtgcacgatggacccgaaaacccgcgcgccgcacactcatccaccggcgcccggctgcagacgcacggcgacgacgtcgccttgagcgtcgcgcgtctcgggcacctgggtcgacatccgattcacgttgccggccaacaccgtcgatggcggcaccccggtgatcgccaccgaggacgccaccacgccatgcgcacggtgctgcgatcgccgccggtgtcgacagcccggagttcttgctgcggtggccaacgggacggccactttgacggtggactggcaccccgagcgtgttgccgaccacaccgtcaccgccacgttcggtgcgcgctggcacccagcctcaccaacgtgccgacgcgactcgtcggcccttgttggccagcggttttcgcggccatcggatcggcggtcaccgacaccggtgagccggtggtggaaggcctgctgagcctggtgcatctggacacgcggccgcgcgtggtcggtcagctgcccacggtcccggcccaattgaccgtcacgcaacggctgccaacgcaaccgatacggacatgggccgcgtcgtgccggtctcggtcgtcgttcaccgcatggcgccgtgatcgccactctcgaggagcgattcgcgatcctgggtcgcaccggttcgccgagctggaccggcgcgagccggtggcgcggtgtcgcgaacgccaccgacaccccgcgcgtcgccgccgcgacgtcacgatcaccgcgccggtcgacatgcgcccgttcgcggtggtgtccggcgaccacaaccccattcacaccgaccgggccgccgctgcttgccggcctggagtcgccgatcgtgcacggcatgtggctgtcggccgcggcgcaacacgcggtgaccggcaccgacgggcaggcccgccaccggcccggctggtcggctggaccgcgcggtttttgggcatggtggccccggcgacgaggtggacttccggtcgagcgcgtcggatcgaccagggcgcagagattgtggacgtggccgcgcgcgtcgggtcggatctagtgatgtcggcctccgcgcgactggccgcacccaagacggtctacgcattccccggccagggcatccaacacaagggcatgggcatggaggtgcgcgccgctccaaggcggcccgcaaggtgtgggacaccgcggacaagttcacccgcgacaccctgggcttctcggtactgcacgtggtccgcgacaacccgaccagcatcatcgccagcggtgtgcactaccaccaccgacggggtgctctacctgacgcagttcacccaggtcgcgatggcgacggtggcggccgggcaggtcgccgagatgcgtgaacagggagccttcgtcgaaggcgccatcgcgtgcggccactcggtcggcgagtacaccgcgctggcctgcgtgaccggcatctaccaactggaagccttgctggagatggtgtttcaccgcgggtcgaagatgcacgacatcgttccgcgcgacgagctcggccgctccaactatcggctgtcggccatccggccgtcccagatcgacctcgacgacgccgacgtgcccgcgttcgtcgccgggatcgcggagagcaccggtgaattcctggagatcgagaatttcaacctcggtggctcgcaatacgcgatcgcgggcacggtacgcggcctcgaggcgctcgaggccgaggtggagcggcgccgcgagctcaccggcggccgacggtcgttcattttggtgcccggcatcgatgttccgttccactcgcgagtgctgcgggtcggggtggccgaattccggcgctcgctggaccgggtcatgcggccgacgcggacccgacctgatcatcgggcgctacattcccaacctggtgccgcggaagttcaaccctggaccgcgacttcatccaggaaatccgggatttggtgccccgccgagccgctcgacgagatcctcgccgactacgacacctggcttcgcgacgaccggcgagatggcgcgcacggtgttcatcgagctgctggcatggcaattcgccagcccggtgcgctggatcgagacgcaggatctgctgttcatcgaggaggcgccggcgggctgggtgtggagcgattcgtcgagatcggtgtgaagagctcaccgacggtggcggggtcttgccaccaacaccctcaaactgcccgaatacgcccacagcacagtgaagtgctcaacgccgagcgtgatgcgcggtgctgttcgccaccgacaccgacccggagccggagccggaggaagacgagccggtcgcggaatcgcccgcgccggacgtcgtctcggaagccgcccccgtcgcgccggccgcttcgtcggcgggcccgcgtcccgacgatctggttttcgacgccgccgatgccacgctgcgtgatcgcgctctcggccaagatgcgcatcgaccagatcgaagaactcgactccatcgagtccatcaccgacggtgcgtcgtcgcggcgcaaccagctgctggtggacctgggctccgagctgaacctcggtgccattgaacggcgccgccgaatcggacctggccggtctgcgctcacaggtgaccaaactggcgcgcacctacaacgttacggcccagtgctttccgacgccatcaacgaccacgttcgcaccgtcctcggaccgtcgggcaagcggcccggcgccatcgccgagcgggtgaagaagacctgggagctcggtgaggctgggccaagcatgtcaccgtcgaggtcgcgctgggcacccgcgagggcagcagcgttcgcggcggcgccatgggccacctgcacgagggcgcgctggccgatgccgcctccgtcgacaaggtcatcgacgcggcggtcgcatcggtggccgcggccagggcgtttcggtagcgctgcgtcggccggtagtggcggcgccaccatcgacgcggccgcgctcagcgagttcaccgaccaaatcaccggccgtgagggcgtgctgcctccgcggcccgcctggtgctggggcagctgggactggacgaccccatcaaccgttgccggccgccccgattccgagctgatcgacttggtcaccgccgaactgggacggactggccgcggttggtggcaccggtgttcgaccccaagaaggccgtcgtattcgacgaccgctggccagcgcccgcgaggacctggtgaagctgtggctgaccgacggaaggaccgaaggcgacatcgacgccgactggccgcgctggcggagcgcttcgagggtgccgccacgtcgtggcgacccaggctacctggtggcaaggtaagtcgctcgcgcgggccggcagatccatgcatcgctgtacggccgcatgccgccggcgccgagaaccccgaaccccgcgtacggcggcgaagttgccgtggtgaccggcgcttcgaagggttcgatcgccgcgtcggtggtggctcggctgctcgacgcggagccaccgtcatcgcgaccacctccaagctcgacgaggagcggctgcggttctaccgcacgctgtatcgcgaccacgcccgttacggcgcggcgctgtggctggtcgcggcgaacatggcgtcctactccgacgtcgacgccctggtcgaatggatcggcaccgaacagaccgaaagccttgggccgcagtcgattcacatcaaagacgcgcagaccccgacgctgctgttccgttcgcggcgcacgcgtgtcgggactgtcggaggccggttcgcgcgccgagatggagatgaaagtgctgctgtggcggtgcaacggctgatcggcggcctgtcgacgatcggcgccgaacgcgacatgccgtcgcggctcgagcgtggtgctgcccggctcgcccaaccgtggcatgttcggcggcgacgggccctacggcgaagccaagtccgcgctggatgccgtggtgacgcgctggcacgccgagtcgtcctgggcggcacgggtcagcctggcgcacgcgctcatcggctggacccgcggcaccgggctgatgggccacaacgatgccatcgtggccgccgtcgaagaggccggggtcaccacctactcgaccgacgagatggcgcggctgctgctcgacctgtgtcatgcggaatccaaggtggctgcggccgttcgccgatcaaggccgacctgaccgggggcctgccgaggccaacctcgacatggccgagctggcggccaaggcgcgcgagcagatgtcggcagcggcggccgtcgacgaggacgccgaggcccctggcgccatcgccgcgctgccgtcgccgccccggtttcacccccgcaccgccgccgcaatgggacgacctcgatgtcgacccggccgacctggtggtgatcgtcggcggccgcgaaatcggcccgtacggctcgtcacgcacccggttcgagatggaggtcgaaaacgagctgtcggcggccggcgtgctggagctggcctggaccactgggttgatcgctgggagacgacccgcaacccggttggtacgacaccgaatccggcgaaatggtcgacgaatccgagttggtgcagcgctacacgacgccgtggtgcagcgcgtcggcattcgcgaattcgttgatgacggcgcgatcgaccccgaccacgcctcgccgctgctggtgtcggtgttcctggagaaggacttcgcgttcgtggtgtcctcggaggccgatgcgcgcgccttcgtcgagttcgatcccgagcacacggtcatccggccggtgcccgactccaccgactggcaggtcatccgcaaggccggcaccgagatccgggtgccgcgaaagaccaagctgtcccgcgtcgtcggcggccagatcccgaccgggttcgacccgacggtgtggggcatcagcgcagacatggccggttccatcgaccggttggcggtatggaacatgtggcggaccgtcgaccggttcctgtcgtccggtttcagcccggccgaggtgatgcgttacgtgcacccgagtttggtggccaacacccagggcaccggcatgggcggcggcacgtcgatgcagacgatgtaccacggcaatctgttgggccgcaacaagccgaacgacatcttccaggaagtcttgccgatatcattcgccgcgcacgtggttcagtcctacgtcggtagctacggtgcgatgatccacccggtagccgcgtgcgccaccgccgcggtgtcggtcgaggaaggtgtcgacaagatccggttgggaaggctcaactggtggtcggcggccgtggatgacctgacgctggagggcatcatcggattcggtgacatggccgccaccgccgacacgtccatgatgcgcggccgcggcatccacgactcgaagttttcccggcccaacgaccgccgccgtctggcttcgtcgaagcccaaggcggcgggacgatcctgttgggcgcggggacctggcgctgcggatggggctgccggtgctggcggtggtgggttcgcgcagtcgttcggcgacggcgtgcacacctcgatccgccccgggcctgggcgcgctgggggcggcgcgcggcggcaaggattcagctgcggcgggcgctggccaagctgcgtggccgccgacgacgtggcggtcatctccaagcacgacacctcgacgctggccaacgatcccaacgagaccgagttgcatgaacggctcgccgacgccctgggccgttccgagggcgccccgctgttcgtggtgtcgcagaagagcctgaccggccagccaagggcggcgcggcggtcttccagatga

SEQ ID NO: 56 - protein, 2796 aa, Mycobacterium bovis
MGTRTGGRGPGSVRQAPDVGRRVGARRVAYPDRGDPGAGPSRHGPRGHPAGRHGGHSQGVLAVEALKAGGARDVELFALAQLIGAAGTLVARRREFPSWAIAPMVSVTNADPERIGRLLDEFAQDVRTVLPPVLSIRNGRRAVVITGTPEQLSRFELYCRQISEKEEADRKNKVRGGDVFSPVFEPVQVEVGFHTPRLSDGIDIVAGWAEKAGLDVALARELADAILIRKVDWVDEITRVHRAGARWILDLGPGDILTRLTAPVIRGLGIGIVPARTRGGQRNLFTVGATPEVARAWSSYAPTVVRLPDGRVKLSTKFTRLTRRSPILLAGMTPTTVDAKIVAAAANGRHWAELAARGRSPKRSSVTASNKWPACSSRAAPISSTRCSSIPTCEASGGRQAVGAEGPPVRRRDRRRGDQRRHPRPRRGRRADRRTGRHRHQPRRVQTRDHRADPLGDSHRHRGAHQAGDHARRGPGAPAGTIPGRISHLLLATYSADRAPRQHHVCVGGGHLGTPKKGCGYLSGPGRSVRLPIDADRRILVGTAAMATKESTTSPSVKRMLVDTQGTDQWISAGKAQGRMPPAESARCRHPRDRHSASVRRCSTRWPVTRRRSRSVAWPRPPSPTCRRRRHDLPAVAAGATSNWPSGKATRPPTPPRWAARGWPTLAGPLRADAAACRSPVAPTGFRPDPDAIHRCWPAGQSAAAIAALVARYPDAETVQLHPADVPFFVTLCKTLGKPVNFVPAIDLVVRAGGAATRCGRPTTPATTPMRCASFRARVGSRITRMDEPVGELLDAFEQAAIDEVLGAGVEPKDVASGRLGRADVAGPLAVVLDAPDVRWAGRTVTNPVHRIRDPAEWQVHDGPENPRAAHSSTGARLQTHGDDVALSVARLGHLGRHPIHVAGQHRRWRHPGDRHRGRHHAMRTVLRSPPVSTARSSCCGGQRDGHFDGGLAPRACCRPHRHRHVRCALAPSLTNVPTRLVGPCWPAVFAAIGSAVTDTGEPVVEGLLSLVHLDTRPRVVGQLPTVPAQLTVTQRLPTQPIRTWAASCRSRSSFTAWRRDRHSRGAIRDPGSHRFAELDRREPVARCRERHRHPARRRRDVTITAPVDMRPFAVVSGDHNPIHTDRAAAACRPGVADRARHVAVGRGATRGDRHRRAGPPPARLVGWTARFLGMVAPATRWTSGRARRIDQGAEIVDVAARVGSDLVMSASARLAAPKTVYAFPGQGIQHKGMGMEVRAAPRRPARCGTPRTSSPATPWASRYCTWSATTRPASSPAVCTTTTDGVLYLTQFTQVAMATVAAGQVAEMREQGAFVEGAIACGHSVGEYTALACVTGIYQLEALLEMVFHRGSKMHDIVPRDELGRSNYRLSAIRPSQIDLDDADVPAFVAGIAESTGEFLEIENFNLGGSQYAIAGTVRGLEALEAEVERRRELTGGRRSFILVPGIDVPFHSRVLRVGVAEFRRSLDRVMRPTRTRPDHRALHSQPGAAEVQPWTATSSRKSGIWCPAEPLDEILADYDTWLRDDRRDGAHGVHRAAGMAIRQPGALDRDAGSAVHRGGAGGLGVERFVEIGVKSSPTVAGSCHQHPQTARIRPQHSEVLNAERDARCCSPPTPTRSRSRRKTSRSRNRPRRTSSRKPPPSRRPLRRRARVPTIWFSTPPMPRCVIALSAKMRIDQIEELDSIESITDGASSRRNQLLVDLGSELNLGAIERRRRIGPGRSALTGDQTGAHLQRYGPVLSDAINDHVRTVLGPSGKRPGAIAERVKKTWELGEAGPSMSPSRSRWAPARAAAFAAAPWATCTRARWPMPPPSTRSSTRRSHRWPRPGRFGSAASAGSGGATIDAAALSEFTDQITGREGVLPPRPAWCWGSWDWTTPSTVAGRPDSELIDLVTAELGRTGRGWWHRCSTPRRPSYSTTAGQRPRGPGEAVADRRKDRRRHRRRLAALAERFEGAATSWRPRLPGGKVSRSRGPADPCIAVRPHAAGAENPEPRVRRRSCRGDRRFEGFDRRVGGGSAARRGATVIATTSKLDEERLRFYRTLYRDHARYGAALWLVAANMASYSDVDALVEWIGTEQTESLGPQSIHIKDAQTPTLLFRSRRTRVGTVGGRFARRDGDESAAVAVQRLIGGLSTIGAERDMPSRLERGAARLAQPWHVRRRRALRRSQVRAGCRGDALARRVVLGGTGQPGARAHRLDPRHRADGPQRCHRGRRRRGRGHHLLDRRDGAAAARPVSCGIQGGCGRSPIKADLTGGLPRPTSTWPSWRPRRASRCRQRRPSTRTPRPLAPSPRCRRRPGFTPAPPPQWDDLDVDPADLVVIVGGREIGPYGSSRTRFEMEVENELSAAGVLELAWTTGLIAGRRPATRLVRHRIRRNGRRIRVGAALHDAVVQRVGIREFVDDGAIDPDHASPLLVSVFLEKDFAFVVSSEADARAFVEFDPEHTVIRPVPDSTDWQVIRKAGTEIRVPRKTKLSRVVGGQIPTGFDPTVWGISADMAGSIDRLAVWNMWRTVDRFLSSGFSPAEVMRYVHPSLVANTQGTGMGGGTSMQTMYHGNLLGRNKPNDIFQEVLPISFAAHVVQSYVGSYGAMIHPVAACATAAVSVEEGVDKIRLGRLNWWSAAVDDLTLEGIIGFGDMAATADTSMMRGRGIHDSKFSRPNDRRRLASSKPKAAGRSCWARGPGAADGAAGAGGGGFAQSFGDGVHTSIRPGPGRAGGGARRQGFSCGGRWPSCVAADDVAVISKHDTSTLANDPNETELHERLADALGRSEGAPLFVVSQKSLTGQPRAARRSSR

SEQ ID NO: 57 - DNA, 192 bp, Homo sapiens
  CDS (1)..(192)
gatcttgctgcccgaaactgcctggtaggggagaaccacttggtgaaggtagctgattttggcctgagcaggttgatgacaggggacacctacacagcccatgctggagccaagttccccatcaaatggactgcacccgagagcctggcctacaacaagttctccatcaagtccgacgtctggggtaagggc

SEQ ID NO: 58 - protein, 64 aa, Homo sapiens
DLAARNCLVGENHLVKVADFGLSRLMTGDTYTAHAGAKFPIKWTAPESLAYNKFSIKSDVWGKG

SEQ ID NO: 59 - DNA, 3955 bp, Rattus norvegicus
  CDS (17)..(3799)
ccgggccggagccgcaatgatcatcatggagctggcggcctggtgccgctgggggttcctcctcgccctcctgccccccggaatcgcgggcacccaagtgtgtaccggcacagacatgaagttgcggctccctgccagtcctgagacccacctggacatgctccgccacctgtaccagggctgtcaggtagtgcagggcaacttggagcttacctacgtgcctgccaatgccagcctctcattcctgcaggacatccaggaagttcagggttacatgctcatcgctcacaaccaggtgaagcgcgtcccactgcaaaggctgcgcatcgtgagagggacccagctctttgaggacaagtatgccctggctgtgctagacaaccgagatcctcaggacaatgtcgccgcctccaccccaggcagaaccccagaggggctgcgggagctgcagcttcgaagtctcacagagatcctgaagggaggagttttgatccgtgggaaccctcagctctgctaccaggacatggttttgtggaaggacgtcttccgcaagaataaccaactggctcctgtcgatatagacaccaatcgttcccgggcctgtccaccttgtgcccccgcctgcaaagacaatcactgttggggtgagagtccggaagactgtcagatcttgactggcaccatctgtaccagtggttgtgcccggtgcaagggccggctgcccactgactgctgccatgagcagtgtgccgcaggctgcacgggccccaagcattctgactgcctggcctgcctccacttcaatcatagtggtatctgtgagctgcactgcccagccctcgtcacctacaacacagacacctttgagtccatgcacaaccctgagggtcgctacacctttggtgccagctgcgtgaccacctgcccctacaactacctgtctacggaagtgggatcctgcactctggtgtgtcccccgaataaccaagaggtcacagctgaggacggaacacagcgttgtgagaaatgcagcaagccctgtgctcgagtgtgctatggtctgggcatggagcaccttcgaggggcgagggccatcaccagtgacaatgtccaggagtttgatggctgcaagaagatctttgggagcctggcatttttgccggagagctttgatggggacccctcctccggcattgctccgctgaggcctgagcagctccaagtgttcgaaaccctggaggagatcacaggttacctgtacatctcagcatggccagacagtctccgtgacctcagtgtcttccagaaccttcgaatcattcggggacggattctccacgatggcgcgtactcattgacactgcaaggcctggggatccactcgctggggctgcgctcactgcgggagctgggcagtggattggctctgattcaccgcaacgcccatctctgctttgtacacactgtaccttgggaccagctcttccggaacccacatcaggccctgctccacagtgggaaccggccggaagaggacttgtgcgtctcgagcggcttggtctgtaactcactgtgtgcccacgggcactgctgggggccagggcccacccagtgtgtcaactgcagtcatttccttcggggccaggagtgtgtggaggagtgccgagtatggaaggggctcccccgggagtatgtgagtgacaagcgctgtctgccgtgtcaccccgagtgtcagcctcaaaacagctcagagacctgctttggatcggaggctgatcagtgtgcagcctgcgcccactacaaggactcgtcctcctgtgtggctcgctgccccagtggtgtgaaaccggacctctcctacatgcccatctggaagtacccggatgaggagggcatatgccagccgtgccccatcaactgcacccactcctgtgtggatctggatgaacgaggctgcccagcagagcagagagccagcccggtgacattcatcattgcaactgtagagggcgtcctgctgttcctgatcttagtggtggtcgttggaatcctaatcaaacgaaggagacagaagatccggaagtatacgatgcgtaggctgctgcaggaaactgagttagtggagccgctgacgcccagcggagcaatgcccaaccaggctcagatgcggatcctaaaagagacggagctaaggaaggtgaaggtgcttggatcaggagcttttggcactgtctacaagggcatctggatcccagatggggagaatgtgaaaatccccgtggctatcaaggtgttgagagaaaacacatctcctaaagccaacaaagaaattctagatgaagcgtatgtgatggctggtgtgggttctccgtatgtgtcccgcctcctgggcatctgcctgacatccacagtacagctggtgacacagcttatgccctacggctgccttctggaccatgtccgagaacaccgaggtcgcctaggctcccaggacctgctcaactggtgtgttcagattgccaaggggatgagctacctggaggacgtgcggcttgtacacagggacctggctgcccggaatgtgctagtcaagagtcccaaccacgtcaagattacagatttcgggctggctcggctgctggacattgatgagacagagtaccatgcagatgggggcaaggtgcccatcaaatggatggcattggaatctattctcagacgccggttcacccatcagagtgatgtgtggagctatggagtgactgtgtgggagctgatgacttttggggccaaaccttacgatggaatcccagcccgggagatccctgatttgctggagaagggagaacgcctacctcagcctccaatctgcaccattgatgtctacatgattatggtcaaatgttggatgattgactctgaatgtcgcccgagattccgggagttggtgtcagaattttcacgtatggcgagggacccccagcgttttgtggtcatccagaacgaggacttgggcccatccagccccatggacagtaccttctaccgttcactgctggaagatgatgacatgggtgacctggtagacgctgaagagtatctggtgccccagcagggattcttctccccggaccctaccccaggcactgggagcacagcccatagaaggcaccgcagctcgtccaccaggagtggaggtggtgagctgacactgggcctggagccctcggaagaagggccccccagatctccactggctccctcggaaggggctggctccgatgtgtttgatggtgacctggcaatgggggtaaccaaagggctgcagagcctctctccacatgacctcagccctctacagcggtacagcgaggaccccacattacctctgccccccgagactgatggctatgttgctcccctggcctgcagcccccagcccgagtatgtgaaccaatcagaggttcagcctcagcctcctttaaccccagagggtcctctgcctcctgtccggcctgctggtgctactctagaaagacccaagactctctctcctgggaagaatggggttgtcaaagacgtttttgccttcgggggtgctgtggagaaccctgaatacttagtaccgagagaaggcactgcctctccgccccacccttctcctgccttcagcccagcctttgacaacctctattactgggaccagaactcatcggagcaggggcctccaccaagtaactttgaagggacccccactgcagagaaccctgagtacctaggcctggatgtacctgtatgagacgtgtgcagacgtcctgtgctttcagagtggggaaggcctgacttgtggtctccatcgccacaaagcagggagagggtcctctggccacattacatccagggcagacggctctaccaggaacctgccccgaggaacctttccttgctgcttgaa

SEQ ID NO: 60 - protein, 1260 aa, Rattus norvegicus
MIIMELAAWCRWGFLLALLPPGIAGTQVCTGTDMKLRLPASPETHLDMLRHLYQGCQVVQGNLELTYVPANASLSFLQDIQEVQGYMLIAHNQVKRVPLQRLRIVRGTQLFEDKYALAVLDNRDPQDNVAASTPGRTPEGLRELQLRSLTEILKGGVLIRGNPQLCYQDMVLWKDVFRKNNQLAPVDIDTNRSRACPPCAPACKDNHCWGESPEDCQILTGTICTSGCARCKGRLPTDCCHEQCAAGCTGPKHSDCLACLHFNHSGICELHCPALVTYNTDTFESMHNPEGRYTFGASCVTTCPYNYLSTEVGSCTLVCPPNNQEVTAEDGTQRCEKCSKPCARVCYGLGMEHLRGARAITSDNVQEFDGCKKIFGSLAFLPESFDGDPSSGIAPLRPEQLQVFETLEEITGYLYISAWPDSLRDLSVFQNLRIIRGRILHDGAYSLTLQGLGIHSLGLRSLRELGSGLALIHRNAHLCFVHTVPWDQLFRNPHQALLHSGNRPEEDLCVSSGLVCNSLCAHGHCWGPGPTQCVNCSHFLRGQECVEECRVWKGLPREYVSDKRCLPCHPECQPQNSSETCFGSEADQCAACAHYKDSSSCVARCPSGVKPDLSYMPIWKYPDEEGICQPCPINCTHSCVDLDERGCPAEQRASPVTFIIATVEGVLLFLILVVVVGILIKRRRQKIRKYTMRRLLQETELVEPLTPSGAMPNQAQMRILKETELRKVKVLGSGAFGTVYKGIWIPDGENVKIPVAIKVLRENTSPKANKEILDEAYVMAGVGSPYVSRLLGICLTSTVQLVTQLMPYGCLLDHVREHRGRLGSQDLLNWCVQIAKGMSYLEDVRLVHRDLAARNVLVKSPNHVKITDFGLARLLDIDETEYHADGGKVPIKWMALESILRRRFTHQSDVWSYGVTVWELMTFGAKPYDGIPAREIPDLLEKGERLPQPPICTIDVYMIMVKCWMIDSECRPRFRELVSEFSRMARDPQRFVVIQNEDLGPSSPMDSTFYRSLLEDDDMGDLVDAEEYLVPQQGFFSPDPTPGTGSTAHRRHRSSSTRSGGGELTLGLEPSEEGPPRSPLAPSEGAGSDVFDGDLAMGVTKGLQSLSPHDLSPLQRYSEDPTLPLPPETDGYVAPLACSPQPEYVNQSEVQPQPPLTPEGPLPPVRPAGATLERPKTLSPGKNGVVKDVFAFGGAVENPEYLVPREGTASPPHPSPAFSPAFDNLYYWDQNSSEQGPPPSNFEGTPTAENPEYLGLDVPV

SEQ ID NO: 61 - DNA, 4989 bp, Homo sapiens
  CDS (46)..(4149)
ttttttttttttttgagaaagggaatttcatcccaaataaaaggaatgaagtctggctccggaggagggtccccgacctcgctgtgggggctcctgtttctctccgccgcgctctcgctctggccgacgagtggagaaatctgcgggccaggcatcgacatccgcaacgactatcagcagctgaagcgcctggagaactgcacggtgatcgagggctacctccacatcctgctcatctccaaggccgaggactaccgcagctaccgcttccccaagctcacggtcattaccgagtacttgctgctgttccgagtggctggcctcgagagcctcggagacctcttccccaacctcacggtcatccgcggctggaaactcttctacaactacgccctggtcatcttcgagatgaccaatctcaaggatattgggctttacaacctgaggaacattactcggggggccatcaggattgagaaaaatgctgacctctgttacctctccactgtggactggtccctgatcctggatgcggtgtccaataactacattgtggggaataagcccccaaaggaatgtggggacctgtgtccagggaccatggaggagaagccgatgtgtgagaagaccaccatcaacaatgagtacaactaccgctgctggaccacaaaccgctgccagaaaatgtgcccaagcacgtgtgggaagcgggcgtgcaccgagaacaatgagtgctgccaccccgagtgcctgggcagctgcagcgcgcctgacaacgacacggcctgtgtagcttgccgccactactactatgccggtgtctgtgtgcctgcctgcccgcccaacacctacaggtttgagggctggcgctgtgtggaccgtgacttctgcgccaacatcctcagcgccgagagcagcgactccgaggggtttgtgatccacgacggcgagtgcatgcaggagtgcccctcgggcttcatccgcaacggcagccagagcatgtactgcatcccttgtgaaggtccttgcccgaaggtctgtgaggaagaaaagaaaacaaagaccattgattctgttacttctgctcagatgctccaaggatgcaccatcttcaagggcaatttgctcattaacatccgacgggggaataacattgcttcagagctggagaacttcatggggctcatcgaggtggtgacgggctacgtgaagatccgccattctcatgccttggtctccttgtccttcctaaaaaaccttcgcctcatcctaggagaggagcagctagaagggaattactccttctacgtcctcgacaaccagaacttgcagcaactgtgggactgggaccaccgcaacctgaccatcaaagcagggaaaatgtactttgctttcaatcccaaattatgtgtttccgaaatttaccgcatggaggaagtgacggggactaaagggcgccaaagcaaaggggacataaacaccaggaacaacggggagagagcctcctgtgaaagtgacgtcctgcatttcacctccaccaccacgtcgaagaatcgcatcatcataacctggcaccggtaccggccccctgactacagggatctcatcagcttcaccgtttactacaaggaagcaccctttaagaatgtcacagagtatgatgggcaggatgcctgcggctccaacagctggaacatggtggacgtggacctcccgcccaacaaggacgtggagcccggcatcttactacatgggctgaagccctggactcagtacgccgtttacgtcaaggctgtgaccctcaccatggtggagaacgaccatatccgtggggccaagagtgagatcttgtacattcgcaccaatgcttcagttccttccattcccttggacgttctttcagcatcgaactcctcttctcagttaatcgtgaagtggaaccctccctctctgcccaacggcaacctgagttactacattgtgcgctggcagcggcagcctcaggacggctacctttaccggcacaattactgctccaaagacaaaatccccatcaggaagtatgccgacggcaccatcgacattgaggaggtcacagagaaccccaagactgaggtgtgtggtggggagaaagggccttgctgcgcctgccccaaaactgaagccgagaagcaggccgagaaggaggaggctgaataccgcaaagtctttgagaatttcctgcacaactccatcttcgtgcccagacctgaaaggaagcggagagatgtcatgcaagtggccaacaccaccatgtccagccgaagcaggaacaccacggccgcagacacctacaacatcaccgacccggaagagctggagacagagtaccctttctttgagagcagagtggataacaaggagagaactgtcatttctaaccttcggcctttcacattgtaccgcatcgatatccacagctgcaaccacgaggctgagaagctgggctgcagcgcctccaacttcgtctttgcaaggactatgcccgcagaaggagcagatgacattcctgggccagtgacctgggagccaaggcctgaaaactccatctttttaaagtggccggaacctgagaatcccaatggattgattctaatgtatgaaataaaatacggatcacaagttgaggatcagcgagaatgtgtgtccagacaggaatacaggaagtatggaggggccaagctaaaccggctaaacccggggaactacacagcccggattcaggccacatctctctctgggaatgggtcgtggacagatcctgtgttcttctatgtccaggccaaaacaggatatgaaaacttcatccatctgatcatcgctctgcccgtcgctgtcctgttgatcgtgggagggttggtgattatgctgtacgtcttccatagaaagagaaataacagcaggctggggaatggagtgctgtatgcctctgtgaacccggagtacttcagcgctgctgatgtgtacgttcctgatgagtgggaggtggctcgggagaagatcaccatgagccgggaacttgggcaggggtcgtttgggatggtctatgaaggagttgccaagggtgtggtgaaagatgaacctgaaaccagagtggccattaaaacagtgaacgaggccgcaagcatgcgtgagaggattgagtttctcaacgaagcttctgtgatgaaggagttcaattgtcaccatgtggtgcgattgctgggtgtggtgtcccaaggccagccaacactggtcatcatggaactgatgacacggggcgatctcaaaagttatctccggtctctgaggccagaaatggagaataatccagtcctagcacctccaagcctgagcaagatgattcagatggccggagagattgcagacggcatggcatacctcaacgccaataagttcgtccacagagaccttgctgcccggaattgcatggtagccgaagatttcacagtcaaaatcggagattttggtatgacgcgagatatctatgagacagactattaccggaaaggaggcaaagggctgctgcccgtgcgctggatgtctcctgagtccctcaaggatggagtcttcaccacttactcggacgtctggtccttcggggtcgtcctctgggagatcgccacactggccgagcagccctaccagggcttgtccaacgagcaagtccttcgcttcgtcatggagggcggccttctggacaagccagacaactgtcctgacatgctgtttgaactgatgcgcatgtgctggcagtataaccccaagatgaggccttccttcctggagatcatcagcagcatcaaagaggagatggagcctggcttccgggaggtctccttctactacagcgaggagaacaagctgcccgagccggaggagctggacctggagccagagaacatggagagcgtccccctggacccctcggcctcctcgtcctccctgccactgcccgacagacactcaggacacaaggccgagaacggccccggccctggggtgctggtcctccgcgccagcttcgacgagagacagccttacgcccacatgaacgggggccgcaagaacgagcgggccttgccgctgccccagtcttcgacctgctgatccttggatcctgaatctgtgcaaacagtaacgtgtgcgcacgcgcagcggggtggggggggagagagagttttaacaatccattcacaagcctcctgtacctcagtggatcttcagttctgcccttgctgcccgcgggagacagcttctctgcagtaaaacacatttgggatgttccttttttcaatatgcaagcagctttttattccctgcccaaacccttaactgacatgggcctttaagaaccttaatgacaacacttaatagcaacagagcacttgagaaccagtctcctcactctgtccctgtccttccctgttctccctttctctctcctctctgcttcataacggaaaaataattgccacaagtccagctgggaagccctttttatcagtttgaggaagtggctgtccctgtggccccatccaaccactgtacacacccgcctgacaccgtgggtcattacaaaaaaacacgtggagatggaaatttttacctttatctttcacctttctagggacatgaaatttacaaagggccatcgttcatccaaggctgttaccattttaacgctgcctaattttgccaaaatcctgaactttctccctcatcggcccggcgctgattcctcgtgtccggaggcatgggtgagcatggcagctggttgctccatttgagagacacgctggcgacacactccgtccatccgactgcccctgctgtgctgctcaaggccacaggcacacaggtctcattgcttctgactagattattatttgggggaactggacacaataggtctttctctcagtgaaggtggggagaagctgaaccggc

SEQ ID NO: 62 - protein, 1367 aa, Homo sapiens
MKSGSGGGSPTSLWGLLFLSAALSLWPTSGEICGPGIDIRNDYQQLKRLENCTVIEGYLHILLISKAEDYRSYRFPKLTVITEYLLLFRVAGLESLGDLFPNLTVIRGWKLFYNYALVIFEMTNLKDIGLYNLRNITRGAIRIEKNADLCYLSTVDWSLILDAVSNNYIVGNKPPKECGDLCPGTMEEKPMCEKTTINNEYNYRCWTTNRCQKMCPSTCGKRACTENNECCHPECLGSCSAPDNDTACVACRHYYYAGVCVPACPPNTYRFEGWRCVDRDFCANILSAESSDSEGFVIHDGECMQECPSGFIRNGSQSMYCIPCEGPCPKVCEEEKKTKTIDSVTSAQMLQGCTIFKGNLLINIRRGNNIASELENFMGLIEVVTGYVKIRHSHALVSLSFLKNLRLILGEEQLEGNYSFYVLDNQNLQQLWDWDHRNLTIKAGKMYFAFNPKLCVSEIYRMEEVTGTKGRQSKGDINTRNNGERASCESDVLHFTSTTTSKNRIIITWHRYRPPDYRDLISFTVYYKEAPFKNVTEYDGQDACGSNSWNMVDVDLPPNKDVEPGILLHGLKPWTQYAVYVKAVTLTMVENDHIRGAKSEILYIRTNASVPSIPLDVLSASNSSSQLIVKWNPPSLPNGNLSYYIVRWQRQPQDGYLYRHNYCSKDKIPIRKYADGTIDIEEVTENPKTEVCGGEKGPCCACPKTEAEKQAEKEEAEYRKVFENFLHNSIFVPRPERKRRDVMQVANTTMSSRSRNTTAADTYNITDPEELETEYPFFESRVDNKERTVISNLRPFTLYRIDIHSCNHEAEKLGCSASNFVFARTMPAEGADDIPGPVTWEPRPENSIFLKWPEPENPNGLILMYEIKYGSQVEDQRECVSRQEYRKYGGAKLNRLNPGNYTARIQATSLSGNGSWTDPVFFYVQAKTGYENFIHLIIALPVAVLLIVGGLVIMLYVFHRKRNNSRLGNGVLYASVNPEYFSAADVYVPDEWEVAREKITMSRELGQGSFGMVYEGVAKGVVKDEPETRVAIKTVNEAASMRERIEFLNEASVMKEFNCHHVVRLLGVVSQGQPTLVIMELMTRGDLKSYLRSLRPEMENNPVLAPPSLSKMIQMAGEIADGMAYLNANKFVHRDLAARNCMVAEDFTVKIGDFGMTRDIYETDYYRKGGKGLLPVRWMSPESLKDGVFTTYSDVWSFGVVLWEIATLAEQPYQGLSNEQVLRFVMEGGLLDKPDNCPDMLFELMRMCWQYNPKMRPSFLEIISSIKEEMEPGFREVSFYYSEENKLPEPEELDLEPENMESVPLDPSASSSSLPLPDRHSGHKAENGPGPGVLVLRASFDERQPYAHMNGGRKNERALPLPQSSTC

SEQ ID NO: 63 - DNA, 640 bp, Homo sapiens
  CDS (17)..(592)
tcgggcctccgaaaccatgaactttctgctgtcttgggtgcattggagccttgccttgctgctctacctccaccatgccaagtggtcccaggctgcacccatggcagaaggaggggggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcagattatgcggatcaaacctcaccaaggccagcacataggagagatgagcttcctacagcacaacaaatgtgaatgcagaccaaagaaagatagagcaagacaagaaaatccctgtgggccttgctcagagcggagaaagcatttgtttgtacaagatccgcagacgtgtaaatgttcctgcaaaaacacagactcgcgttgcaaggcgaggcagcttgagttaaacgaacgtacttgcagatgtgacaagccgaggcggtgagccgggcaggaggaaggagcctccctcagggtttcgggaaccagatct

SEQ ID NO: 64 - protein, 191 aa, Homo sapiens
MNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQENPCGPCSERRKHLFVQDPQTCKCSCKNTDSRCKARQLELNERTCRCDKPRR

SEQ ID NO: 65 - DNA, 3690 bp, Mus musculus
  CDS (256)..(3690)
ctggaggggtataaatacctgatggctgctgccagggtcacaactttacagggagttgaagactgagactctggccccacgggacacagtgtcactggtttgaaacttctcagccaccttggtgaagggactgagctgttagagacacttctgaggctcctcacgcttgggtcttgttcactccacggagtagcctagtcaactgcaagagaacggagaacgttggatttggagcagaagtgcaaagtctcagacatggcttgcccctggaagtttctcttcaaagtcaaatcctaccaaagtgacctgaaagaggaaaaggacattaacaacaacgtgaagaaaaccccttgtgctgttctcagcccaacaatacaagatgaccctaagagtcaccaaaatggctccccgcagctcctcactgggacagcacagaatgttccagaatccctggacaagctgcatgtgacatcgacccgtccacagtatgtgaggatcaaaaactggggcagtggagagattttgcatgacactcttcaccacaaggccacatcggatttcacttgcaagtccaagtcttgcttggggtccatcatgaaccccaagagtttgaccagaggacccagagacaagcctacccctctggaggagctcctgcctcatgccattgagttcatcaaccagtattatggctcctttaaagaggcaaaaatagaggaacatctggccaggctggaagctgtaacaaaggaaatagaaacaacaggaacctaccagctcactctggatgagctcatctttgccaccaagatggcctggaggaatgcccctcgctgcatcggcaggatccagtggtccaacctgcaggtctttgacgctcggaactgtagcacagcacaggaaatgtttcagcacatctgcagacacatactttatgccaccaacaatggcaacatcaggtcggccatcactgtgttcccccagcggagtgacggcaaacatgacttcaggctctggaattcacagctcatccggtacgctggctaccagatgcccgatggcaccatcagaggggatgctgccaccttggagttcacccagttgtgcatcgacctaggctggaagccccgctatggccgctttgatgtgctgcctctggtcttgcaagctgatggtcaagatccagaggtctttgaaatccctcctgatcttgtgttggaggtgaccatggagcatcccaagtacgagtggttccaggagctcgggttgaagtggtatgcactgcctgccgtggccaacatgctactggaggtgggtggcctcgaattcccagcctgccccttcaatggttggtacatgggcaccgagattggagttcgagacttctgtgacacacagcgctacaacatcctggaggaagtgggccgaaggatgggcctggagacccacacactggcctccctctggaaagaccgggctgtcacggagatcaatgtggctgtgctccatagtttccagaagcagaatgtgaccatcatggaccaccacacagcctcagagtccttcatgaagcacatgcagaatgagtaccgggcccgtggaggctgcccggcagactggatttggctggtccctccagtgtctgggagcatcacccctgtgttccaccaggagatgttgaactatgtcctatctccattctactactaccagatcgagccctggaagacccacatctggcagaatgagaagctgaggcccaggaggagagagatccgatttagagtcttggtgaaagtggtgttctttgcttccatgctaatgcgaaaggtcatggcttcacgggtcagagccacagtcctctttgctactgagacagggaagtctgaagcactagccagggacctggccaccttgttcagctacgccttcaacaccaaggttgtctgcatggaccagtataaggcaagcaccttggaagaggagcaactactgctggtggtgacaagcacatttgggaatggagactgtcccagcaatgggcagactctgaagaaatctctgttcatgcttagagaactcaaccacaccttcaggtatgctgtgtttggccttggctccagcatgtaccctcagttctgcgcctttgctcatgacatcgaccagaagctgtcccacctgggagcctctcagcttgccccaacaggagaaggggacgaactcagtgggcaggaggatgccttccgcagctgggctgtacaaaccttccgggcagcctgtgagacctttgatgtccgaagcaaacatcacattcagatcccgaaacgcttcacttccaatgcaacatgggagccacagcaatataggctcatccagagcccggagcctttagacctcaacagagccctcagcagcatccatgcaaagaacgtgtttaccatgaggctgaaatcccagcagaatctgcagagtgaaaagtccagccgcaccaccctcctcgttcagctcaccttcgagggcagccgagggcccagctacctgcctggggaacacctggggatcttcccaggcaaccagaccgccctggtgcagggaatcttggagcgagttgtggattgtcctacaccacaccaaactgtgtgcctggaggttctggatgagagcggcagctactgggtcaaagacaagaggctgcccccctgctcactcagccaagccctcacctacttcctggacattacgacccctcccacccagctgcagctccacaagctggctcgctttgccacggacgagacggataggcagagattggaggccttgtgtcagccctcagagtacaatgactggaagttcagcaacaaccccacgttcctggaggtgcttgaagagttcccttccttgcatgtgcccgctgccttcctgctgtcgcagctccctatcttgaagccccgctactactccatcagctcctcccaggaccacaccccctcggaggttcacctcactgtggccgtggtcacctaccgcacccgagatggtcagggtcccctgcaccatggtgtctgcagcacttggatcaggaacctgaagccccaggacccagtgccctgctttgtgcgaagtgtcagtggcttccagctccctgaggacccctcccagccttgcatcctcattgggcctggtacgggcattgctcccttccgaagtttctggcagcagcggctccatgactcccagcacaaagggctcaaaggaggccgcatgagcttggtgtttgggtgccggcacccggaggaggaccacctctatcaggaagaaatgcaggagatggtccgcaagagagtgctgttccaggtgcacacaggctactcccggctgcccggcaaacccaaggtctacgttcaggacatcctgcaaaagcagctggccaatgaggtactcagcgtgctccacggggagcagggccacctctacatttgcggagatgtgcgcatggctcgggatgtggctaccacattgaagaagctggtggccaccaagctgaacttgagcgaggagcaggtggaagactatttcttccagctcaagagccagaaacgttatcatgaagatatcttcggtgcagtcttttcctatggggcaaaaaagggcagcgccttggaggagcccaaagccacgaggctctga

SEQ ID NO: 66 - protein, 1144 aa, Mus musculus
MACPWKFLFKVKSYQSDLKEEKDINNNVKKTPCAVLSPTIQDDPKSHQNGSPQLLTGTAQNVPESLDKLHVTSTRPQYVRIKNWGSGEILHDTLHHKATSDFTCKSKSCLGSIMNPKSLTRGPRDKPTPLEELLPHAIEFINQYYGSFKEAKIEEHLARLEAVTKEIETTGTYQLTLDELIFATKMAWRNAPRCIGRIQWSNLQVFDARNCSTAQEMFQHICRHILYATNNGNIRSAITVFPQRSDGKHDFRLWNSQLIRYAGYQMPDGTIRGDAATLEFTQLCIDLGWKPRYGRFDVLPLVLQADGQDPEVFEIPPDLVLEVTMEHPKYEWFQELGLKWYALPAVANMLLEVGGLEFPACPFNGWYMGTEIGVRDFCDTQRYNILEEVGRRMGLETHTLASLWKDRAVTEINVAVLHSFQKQNVTIMDHHTASESFMKHMQNEYRARGGCPADWIWLVPPVSGSITPVFHQEMLNYVLSPFYYYQIEPWKTHIWQNEKLRPRRREIRFRVLVKVVFFASMLMRKVMASRVRATVLFATETGKSEALARDLATLFSYAFNTKVVCMDQYKASTLEEEQLLLVVTSTFGNGDCPSNGQTLKKSLFMLRELNHTFRYAVFGLGSSMYPQFCAFAHDIDQKLSHLGASQLAPTGEGDELSGQEDAFRSWAVQTFRAACETFDVRSKHHIQIPKRFTSNATWEPQQYRLIQSPEPLDLNRALSSIHAKNVFTMRLKSQQNLQSEKSSRTTLLVQLTFEGSRGPSYLPGEHLGIFPGNQTALVQGILERVVDCPTPHQTVCLEVLDESGSYWVKDKRLPPCSLSQALTYFLDITTPPTQLQLHKLARFATDETDRQRLEALCQPSEYNDWKFSNNPTFLEVLEEFPSLHVPAAFLLSQLPILKPRYYSISSSQDHTPSEVHLTVAVVTYRTRDGQGPLHHGVCSTWIRNLKPQDPVPCFVRSVSGFQLPEDPSQPCILIGPGTGIAPFRSFWQQRLHDSQHKGLKGGRMSLVFGCRHPEEDHLYQEEMQEMVRKRVLFQVHTGYSRLPGKPKVYVQDILQKQLANEVLSVLHGEQGHLYICGDVRMARDVATTLKKLVATKLNLSEEQVEDYFFQLKSQKRYHEDIFGAVFSYGAKKGSALEEPKATRL

SEQ ID NO: 67 - DNA, 10422 bp, Homo sapiens
  CDS (6667)..(10176)
ctgggattgggacacactttctgggcactgctggccagtcccaaaatggaacataaggaagtggttcttctacttcttttatttctgaaatcagcagcacctgagcaaagccatgtggtccaggattgctaccatggtgatggacagagttatcgaggcacgtactccaccactgtcacaggaaggacctgccaagcttggtcatctatgacaccacatcaacataataggaccacagaaaactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagtgcatcctgcctgggagcaagttttccagggcagctttgagaagtcttggagaaacaaacctactaaacctgacagacagtaatactatttgcacaatgcttttctgtgggaaaggtagagccttttcactacgtattgagtacatagagtgtgagggttgacctggaacggctatcctcctggatgacgtgcgttttctgaagaactacatgttcgttgcaactcccacattagaatatgaagtcctaccgagagagatacggagactagacagatacagatgcatttgcatgtgaatacacaatcccacaatacagacgtcaaaacccataccagttattccagagagatggattgggcagaaggcagaaggagaatactctgatcgtttttcggccacgtgtgtgtgttatctcagtgtttctaagaagcgtttgctactttagattttttatttaaaaaaaatagtaataatctattaagtatgagagatgtgcagagaggattagtgatcgagagccatttttgctggtggcaatcatatggtacttttaatgggaatattagaaaggcaccggtaatgaccttgttgcagcacaaaggagagagtgtggggtgcccctgcatgttgtcccacctcttgtgacgtgtatcgttttagaatttccagtggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaaggtaaggagtctgtggccagacatctacacgcttcgatgctgggatgaaaagccatggaaattcccactgatgcagccgccttcaatggtaaacggatgctcgagtgttgcctgagttctaccatgtaggaggaagcctccgtgcactctctgggggagccagcggagtgatttctggtgcaacgtggttgggctttgtctttaggatgggcacaaaccctccagggggatcgacttcaaaattcaccttgttgtaaaacgggctacctcagtgtcccagccaaaatttttattgtaacatgctgtcaggtgtgtcactctttccaagccagtaagcttttccggggatttcttcaagtagccagcattcagagcaatcttcagcattgcagattctgagaaatgtggctctggagcctgtcaccctcgagaaacctaagagggctgcattgattccatgtggccctgggtctatggagcagtacatgagctcccagtgctctaaggctcttcagccctaggctttgaagggagtgatttctcagtattcttaaacctctttctgatgacacttgtacctgtgaggggtctagagagaaagagtagtagactcctactttactacaattcaggatgcagggcatgagaggattccctctctcctccaagggaagaagcttttggcgtgcacacatccctgagaagcaaagtgtctttgtcttcagtcagatacataggaccgttttctgccccatggcccggaagccaaaggccttggctttcatgatcaacggtctagggaaacatgcaaaatttccatgtctgtcccaaactctgcccccgacagccaattaccacctgcagcccgcattgccaaatgcggtgccgtttgcatgaagattcagtagagtttcctagaaaggtgctacctcgtgagctcactttccaatgaggaatctgatctggtgtgtttctctaaggtgtcaggtgaaatatttccaagaacttactacagttctagaatgggaggaatctgctgctttggtgtttgtttgttggtcggttttctcacatccatctgcctatggataaggaaaagagaacggtcgtaattctcatagactcctttctggttgtgtcacaaatggcttcacatgtttctctatgctcagagatactcagcttgatttcccgtgttttcatttcagcaccgactgagcaaaggcctggggtgcaggagtgctaccatggtaatggacagagttatcgaggcacatactccaccactgtcacaggaagaacctgccaagcttggtcatctatgacaccacactcgcatagtcggaccccagaatactacccaaatgcgtatgtctttgttctttaccataagagaagaaagggccaagtgaagtttctgttacaagagatgtgtctcaagctgagttctccgaactcaacttgtgacagatgcagatggcgtagcaaaatgtctcaggatgattgccttggagctaagggtctgagagaagggaaatgttaagctccctctccttcctcctacttctattgagcagaagggaaatctggaggtgaggagatcaccttctgaagaaagtcagaatgacaaaggaccagacacttagattacccttccacaacaccaactaaacgtcaatggagactttccagtctggaacttccgttacttctggccttccaccttccctgaagggaaggttgcgtttgccttttctctctgggttcaagaggaaagaataggtgcttatttatggacaggtgaattgatctgtttctatatctacgtatattccgattgtcagaaaaacactcgttcctaagtaccagtggcctgaagggatacaggttcccagcaagagaagatccaaggaaggaaggcagatgagagtcagcacagagagggatgctgaaaagtaaaagggatgggtggatggagagaagcccgggtctgaccacccaatggccaatattttggccacaagcgactaccagagacatggaaaaatggtttctacatgtgggacaacagatggtagaggacctagagaattgagagaggggcaatgatgggctccactccgcagatgccttggctttcttcctggatacccttcctgcactgaatagcaaggagatggagcccaagcagactgtagccatcttgctgaatggaggagagggattggagtttgggatgactgtggtagctgaaatttttctaggtctgctagaaataagaactggtttgtggaggaaaagagctctacaaatacgcatagaagtctcctccagtcgttggcctgacatgacgctgcctgtgcacaggaaatggttccacgagaaagtgtggcaaagaacatttactgagaaacagcaagtacaagagcacaggaagctcaataaagaagagagagatcacatagcactctgggatactggagttcttcccagctagaccagagagtcctcacggagcacattgccaattcagtggagaccccagaacagccgtaatttaaaggtacacttagtatattactagaataaagtcagctgcagacaaccccttgcacagctggaaagcaagtgtccaagcatcaaatcggtttccaatcaatgaagtgcctgtgagaggaaatctcaactctctttagaagtaaacaacaaagtcgattgcctcagctatgcggtatccgcagagtgagtcctaaatttaaaatctgactacatgtagaaaagcgtttcgtgtgacccatgaccaggaaataaatcgggtaatacaaacaggctcaggaatgagagaaatgattagaattgcgtgaaaatttgaaatatcagtatgataactgatttcaaatatttaaaaaaacaacatgcaagaaagcagatatcatatcaagagaaattaacagtacagaatagccaaattaaattaaagagctagtataaaaaaagtatgtcttaattgaaaaaaattactgtatggccggctgatcaatttagacgtttcagaggaaaacattacccaacacacaattctagagaacctacagaatgagctacacacacacacacacacacacacacaaactgaaaacacacccatactcacacacacgcagaaactcacaagttctaacacacacagacacgcgcacccctgaagaaacagtgaaatataaaattaagcgagcctcacagacatgtaggaaaatatgaaaagatttcctgcatgtgggaagcaagtcacagtaaagagcaagggagtttggaatagaaacaaataccagaatcaaggatggctgataacttttcaattacgaagaacattaaaaaaaatcacagaatcgtgaaactcaagggatcacatagggaatttcggaaaaaaaacccaacctgtatgatgtacttttgtacatcacagttcgaaggtaacaaggcaaagatataataagaagaaacctgtcacgagaaactggaggaaaaagagctgtgtcttcctacaagtacactgatacaaattgccaatgtgttcacctcagaaacactggaagccagataccagggaatattgttaaaatgataatcaggaacaaaaagagatcaaccgggaatgctgaatccagcaataaaatgccttgaagatcatccatgtcggataaatgcatattgtgcactgccccaaagaaagaaaccggaaactgtaagaattggaaatcagcaggcttatgtaacaagagaggtgacccgaaggaattaggtagaagaagaattaacaagaaaggaactttctgcagcccacgtaatgaagaatccagcaattggcaaatgtagatagatgtaaatgcaaaatattttcttgatcaaatttctatatctttgtaaatgagagttgactacttgaaacaaaatgatagcaagatatttaacttcagcatatgtagaggtaagaatttgaaatggtagcataaatcacgaagggattaattcgaagtgtaccgttgtaagtttctttacctcatgcacgatggtgtgtcatattaataaaagggtactgtgcgggttcgaagggatattgcaaatcctagagcaatcacaaaggtttgaactctgaggtttttggtataataagaatagtccatgcattcaaaagagggaagccaaggaagaactagaagtctttcaagagctcaggctcttatacatccagttgctcattgaaccagcttcctggaatggagggtctggggttgagactaggccacaagtctagagtctctagagagacagtgttggaaccccatggcccataatacatttcccattttctcaggcagccagaggtcatgaatgtgaggatactgggaggttggagcaacgttcttgggaggcataaggaagagcgaatgcttcaagatccccgcagcccaaactactcgcctgctttgccccctaatgcatttttctctgctgctccgtagctgtccgacctcttcagatctcttagtccaccctgccgtcttcctttatgccatgggtcccactgttctttcaactcatccccctttccctcagtcccggagtagctgcggccagcagagggtagactgagagcaggagagaaggacctgcctaggaaccccttctagagatactgcatcctgcctgggagcaagttttccagggcagctttgagaagtcttggagaaacaaacctactaaacctgacagacagtaatactatttgcacaatgcttttctgtgggaaaggtagagccttttcactacgtattgagtacatagagtgtgagggttgacctggaacggctatcctcctggatgacgtgtgttttctgaagaactacatgttcgttgcaactcccacattagaatatgaagtcctaccgagagagatacggagactagacagatacagatgcatttgcatgtgaatacacaatcccacaatacagacgtcaaaacccataccagttattccagagagatggattgggcagaaggcagaaggagaatactctgatcgtttttcggccacgtgtgtgtgttatctcagtgtttctaagaagcgtttgctactttagattttttatttaaaaaaaatagtaataatctattaagtatgagagatgtgcagagaggattagtgatcgagagccatttttgctggtggcaatcatatggtacttttaatgggaatattagaaaggcaccggtaatgaccttgttgcagcacaaaggagagagtgtggggtgcccctgcatgttgtcccacctcttgtgacgtgtatcgttttggaatttccagtggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccaactgagcaaaggcctggggtgcaggagtgctaccacggaaatggacagagttatcaaggcacatacttcattactgtcacaggaagaacctgccaagcttggtcatctatgacaccacactcgcatagtcggaccccagcatactacccaaatgctggcttgatcaagaactactgccgaaatccagatcctgtggcagccccttggtgttatacaacagatcccagtgtcaggtgggagtactgcaacctgacacgatgctcagatgcagaatggactgccttcgtccctccgaatgttattctggctccaagcctagaggctttttttgaacaagcactgactgaggaaacccccggggtacaggactgctactaccattatggacagagttaccgaggcacatactccaccactgtcacaggaagaacttgccaagcttggtcatctatgacaccacaccagcatagtcggaccccagaaaactacccaaatgctggcctgaccaggaactactgcaggaatccagatgctgagattcgcccttggtgttacaccatggatcccagtgtcaggtgggagtactgcaacctgacacaatgcctggtgacagaatcaagtgtccttgcaactctcacggtggtcccagatccaagcacagaggcttcttctgaagaagcaccaacggagcaaagccccggggtccaggattgctaccatggtgatggacagagttatcgaggctcattctctaccactgtcacaggaaggacatgtcagtcttggtcctctatgacaccacactggcatcagaggacaacagaatattatccaaatggtggcctgaccaggaactactgcaggaatccagatgctgagattagtccttggtgttataccatggatcccaatgtcagatgggagtactgcaacctgacacaatgtccagtgacagaatcaagtgtccttgcgacgtccacggctgtttctgaacaagcaccaacggagcaaagccccacagtccaggactgctaccatggtgatggacagagttatcgaggctcattctccaccactgttacaggaaggacatgtcagtcttggtcctctatgacaccacactggcatcagagaaccacagaatactacccaaatggtggcctgaccaggaactactgcaggaatccagatgctgagattcgcccttggtgttataccatggatcccagtgtcagatgggagtactgcaacctgacgcaatgtccagtgatggaatcaactctcctcacaactcccacggtggtcccagttccaagcacagagcttccttctgaagaagcaccaactgaaaacagcactggggtccaggactgctaccgaggtgatggacagagttatcgaggcacactctccaccactatcacaggaagaacatgtcagtcttggtcgtctatgacaccacattggcatcggaggatcccattatactatccaaatgctggcctgaccaggaactactgcaggaatccagatgctgagattcgcccttggtgttacaccatggatcccagtgtcaggtgggagtactgcaacctgacacgatgtccagtgacagaatcgagtgtcctcacaactcccacagtggccccggttccaagcacagaggctccttctgaacaagcaccacctgagaaaagccctgtggtccaggattgctaccatggtgatggacggagttatcgaggcatatcctccaccactgtcacaggaaggacctgtcaatcttggtcatctatgataccacactggcatcagaggaccccagaaaactacccaaatgctggcctgaccgagaactactgcaggaatccagattctgggaaacaaccctggtgttacacaaccgatccgtgtgtgaggtgggagtactgcaatctgacacaatgctcagaaacagaatcaggtgtcctagagactcccactgttgttccagttccaagcatggaggctcattctgaagcagcaccaactgagcaaacccctgtggtccggcagtgctaccatggtaatggccagagttatcgaggcacattctccaccactgtcacaggaaggacatgtcaatcttggtcatccatgacaccacaccggcatcagaggaccccagaaaactacccaaatgatggcctgacaatgaactactgcaggaatccagatgccgatacaggcccttggtgttttaccatggaccccagcatcaggtgggagtactgcaacctgacgcgatgctcagacacagaagggactgtggtcgctcctccgactgtcatccaggttccaagcctagggcctccttctgaacaagactgtatgtttgggaatgggaaaggataccggggcaagaaggcaaccactgttactgggacgccatgccaggaatgggctgcccaggagccccatagacacagcacgttcattccagggacaaataaatgggcaggtctggaaaaaaattactgccgtaaccctgatggtgacatcaatggtccctggtgctacacaatgaatccaagaaaactttttgactactgtgatatccctctctgtgcatcctcttcatttgattgtgggaagcctcaagtggagccgaagaaatgtcctggaagcattgtaggggggtgtgtggcccacccacattcctggccctggcaagtcagtctcagaacaaggtttggaaagcacttctgtggaggcaccttaatatccccagagtgggtgctgactgctgctcactgcttgaagaagtcctcaaggccttcatcctacaaggtcatcctgggtgcacaccaagaagtgaacctcgaatctcatgttcaggaaatagaagtgtctaggctgttcttggagcccacacaagcagatattgccttgctaaagctaagcaggcctgccgtcatcactgacaaagtaatgccagcttgtctgccatccccagactacatggtcaccgccaggactgaatgttacatcactggctggggagaaacccaaggtacctttgggactggccttctcaaggaagcccagctccttgttattgagaatgaagtgtgcaatcactataagtatatttgtgctgagcatttggccagaggcactgacagttgccagggtgacagtggagggcctctggtttgcttcgagaaggacaaatacattttacaaggagtcacttcttggggtcttggctgtgcacgccccaataagcctggtgtctatgctcgtgtttcaaggtttgttacttggattgagggaatgatgagaaataattaattggacgggagacagagtgaagcatcaacctacttagaagctgaaacgtgggtaaggatttagcatgctggaaataatagacagcaatcaaacgaagacactgttcccagctaccagctatgccaaaccttggcatttttggtatttttgtgtataagcttttaaggtctgactgacaaattctgtattaaggtgtcatagctatgacatttgttaaaaataaactctgcacttattttgatttga

SEQ ID NO: 68 - protein, 1169 aa, Homo sapiens
MNYCRNPDAVAAPYCYTRDPGVRWEYCNLTQCSDAEGTAVAPPTVTPVPSLEAPSEQAPTEQRPGVQECYHGNGQSYQGTYFITVTGRTCQAWSSMTPHSHSRTPAYYPNAGLIKNYCRNPDPVAAPWCYTTDPSVRWEYCNLTRCSDAEWTAFVPPNVILAPSLEAFFEQALTEETPGVQDCYYHYGQSYRGTYSTTVTGRTCQAWSSMTPHQHSRTPENYPNAGLTRNYCRNPDAEIRPWCYTMDPSVRWEYCNLTQCLVTESSVLATLTVVPDPSTEASSEEAPTEQSPGVQDCYHGDGQSYRGSFSTTVTGRTCQSWSSMTPHWHQRTTEYYPNGGLTRNYCRNPDAEISPWCYTMDPNVRWEYCNLTQCPVTESSVLATSTAVSEQAPTEQSPTVQDCYHGDGQSYRGSFSTTVTGRTCQSWSSMTPHWHQRTTEYYPNGGLTRNYCRNPDAEIRPWCYTMDPSVRWEYCNLTQCPVMESTLLTTPTVVPVPSTELPSEEAPTENSTGVQDCYRGDGQSYRGTLSTTITGRTCQSWSSMTPHWHRRIPLYYPNAGLTRNYCRNPDAEIRPWCYTMDPSVRWEYCNLTRCPVTESSVLTTPTVAPVPSTEAPSEQAPPEKSPVVQDCYHGDGRSYRGISSTTVTGRTCQSWSSMIPHWHQRTPENYPNAGLTENYCRNPDSGKQPWCYTTDPCVRWEYCNLTQCSETESGVLETPTVVPVPSMEAHSEAAPTEQTPVVRQCYHGNGQSYRGTFSTTVTGRTCQSWSSMTPHRHQRTPENYPNDGLTMNYCRNPDADTGPWCFTMDPSIRWEYCNLTRCSDTEGTVVAPPTVIQVPSLGPPSEQDCMFGNGKGYRGKKATTVTGTPCQEWAAQEPHRHSTFIPGTNKWAGLEKNYCRNPDGDINGPWCYTMNPRKLFDYCDIPLCASSSFDCGKPQVEPKKCPGSIVGGCVAHPHSWPWQVSLRTRFGKHFCGGTLISPEWVLTAAHCLKKSSRPSSYKVILGAHQEVNLESHVQEIEVSRLFLEPTQADIALLKLSRPAVITDKVMPACLPSPDYMVTARTECYITGWGETQGTFGTGLLKEAQLLVIENEVCNHYKYICAEHLARGTDSCQGDSGGPLVCFEKDKYILQGVTSWGLGCARPNKPGVYARVSRFVTWIEGMMRNN

SEQ ID NO: 69 - DNA, 14070 bp, Homo sapiens
  CDS (79)..(13770)
gaggagcccgcccagccagccagggccgcgaggccgaggccaggccgcagcccaggagccgccccaccgcagctggcgatggacccgccgaggcccgcgctgctggcgctgctggcgctgcctgcgctgctgctgctgctgctggcgggcgccagggccgaagaggaaatgctggaaaatgtcagcctggtctgtccaaaagatgcgacccgattcaagcacctccggaagtacacatacaactatgaggctgagagttccagtggagtccctgggactgctgattcaagaagtgccaccaggatcaactgcaaggttgagctggaggttccccagctctgcagcttcatcctgaagaccagccagtgcatcctgaaagaggtgtatggcttcaaccctgagggcaaagccttgctgaagaaaaccaagaactctgaggagtttgctgcagccatgtccaggtatgagctcaagctggccattccagaagggaagcaggttttcctttacccggagaaagatgaacctacttacatcctgaacatcaagaggggcatcatttctgccctcctggttcccccagagacagaagaagccaagcaagtgttgtttctggataccgtgtatggaaactgctccactcactttaccgtcaagacgaggaagggcaatgtggcaacagaaatatccactgaaagagacctggggcagtgtgatcgcttcaagcccatccgcacaggcatcagcccacttgctctcatcaaaggcatgacccgccccttgtcaactctgatcagcagcagccagtcctgtcagtacacactggacgctaagaggaagcatgtggcagaagccatctgcaaggagcaacacctcttcctgcctttctcctacaagaataagtatgggatggtagcacaagtgacacagactttgaaacttgaagacacaccaaagatcaacagccgcttctttggtgaaggtactaagaagatgggcctcgcatttgagagcaccaaatccacatcacctccaaagcaggccgaagctgttttgaagactgtccaggaactgaaaaaactaaccatctctgagcaaaatatccagagagctaatctcttcaataagctggttactgagctgagaggcctcagtgatgaagcagtcacatctctcttgccacagctgattgaggtgtccagccccatcactttacaagccttggttcagtgtggacagcctcagtgctccactcacatcctccagtggctgaaacgtgtgcatgccaacccccttctgatagatgtggtcacctacctggtggccctgatccccgagccctcagcacagcagctgcgagagatcttcaacatggcgagggatcagcgcagccgagccaccttgtatgcgctgagccacgcggtcaacaactatcataagacaaaccctacagggacccaggagctgctggacattgctaattacctgatggaacagattcaagatgactgcactggggatgaagattacacctatttgattctgcgggtcattggaaatatgggccaaaccatggagcagttaactccagaactcaagtcttcaatcctgaaatgtgtccaaagtacaaagccatcactgatgatccagaaagctgccatccaggctctgcggaaaatggagcctaaagacaaggaccaggaggttcttcttcagactttccttgatgatgcttctccgggagataagcgactggctgcctatcttatgttgatgaggagtccttcacaggcagatattaacaaaattgtccaaattctaccatgggaacagaatgagcaagtgaagaactttgtggcttcccatattgccaatatcttgaactcagaagaattggatatccaagatctgaaaaagttagtgaaagaagttctgaaagaatctcaacttccaactgtcatggacttcagaaaattctctcggaactatcaactctacaaatctgtttctattccatcacttgacccagcctcagccaaaatagaagggaatcttatatttgatccaaataactaccttcctaaagaaagcatgctgaaaactaccctcactgcctttggatttgcttcagctgacctcatcgagattggcttggaaggaaaaggctttgagccaacattggaagctctttttgggaagcaaggatttttcccagacagtgtcaacaaagctttgtactgggttaatggtcaagttcctgatggtgtctctaaggtcttagtggaccactttggctataccaaagatgataaacatgagcaggatatggtaaatggaataatgctcagtgttgagaagctgattaaagatttgaaatccaaagaagtcccggaagccagagcctacctccgcatcttgggagaggagcttggttttgccagtctccatgacctccagctcctgggaaagctgcttctgatgggtgcccgcactctgcaggggatcccccagatgattggagaggtcatcaggaagggctcaaagaatgacttttttcttcactacatcttcatggagaatgcctttgaactccccactggagctggattacagttgcaaatatcttcatctggagtcattgctcccggagccaaggctggagtaaaactggaagtagccaacatgcaggctgaactggtggcaaaaccctccgtgtctgtggagtttgtgacaaatatgggcatcatcattccggacttcgctaggagtggggtccagatgaacaccaacttcttccacgagtcgggtctggaggctcatgttgccctaaaacctgggaagctgaagtttatcattccttccccaaagagaccagtcaagctgctcagtggaggcaacacattacatttggtctctaccaccaaaacggaggtgatcccacctctcattgagaacaggcagtcctggtcagtttgcaagcaagtctttcctggcctgaattactgcacctcaggcgcttactccaacgccagctccacagactccgcctcctactatccgctgaccggggacaccagattagagctggaactgaggcctacaggagagattgagcagtattctgtcagcgcaacctatgagctccagagagaggacagagccttggtggataccctgaagtttgtaactcaagcagaaggtgcgaagcagactgaggctaccatgacattcaaatataatcggcagagtatgaccttgtccagtgaagtccaaattccggattttgatgttgacctcggaacaatcctcagagttaatgatgaatctactgagggcaaaacgtcttacagactcaccctggacattcagaacaagaaaattactgaggtcgccctcatgggccacctaagttgtgacacaaaggaagaaagaaaaatcaagggtgttatttccataccccgtttgcaagcagaagccagaagtgagatcctcgcccactggtcgcctgccaaactgcttctccaaatggactcatctgctacagcttatggctccacagtttccaagagggtggcatggcattatgatgaagagaagattgaatttgaatggaacacaggcaccaatgtagataccaaaaaaatgacttccaatttccctgtggatctctccgattatcctaagagcttgcatatgtatgctaatagactcctggatcacagagtccctcaaacagacatgactttccggcacgtgggttccaaattaatagttgcaatgagctcatggcttcagaaggcatctgggagtcttccttatacccagactttgcaagaccacctcaatagcctgaaggagttcaacctccagaacatgggattgccagacttccacatcccagaaaacctcttcttaaaaagcgatggccgggtcaaatataccttgaacaagaacagtttgaaaattgagattcctttgccttttggtggcaaatcctccagagatctaaagatgttagagactgttaggacaccagccctccacttcaagtctgtgggattccatctgccatctcgagagttccaagtccctacttttaccattcccaagttgtatcaactgcaagtgcctctcctgggtgttctagacctctccacgaatgtctacagcaacttgtacaactggtccgcctcctacagtggtggcaacaccagcacagaccatttcagccttcgggctcgttaccacatgaaggctgactctgtggttgacctgctttcctacaatgtgcaaggatctggagaaacaacatatgaccacaagaatacgttcacactatcatgtgatgggtctctacgccacaaatttctagattcgaatatcaaattcagtcatgtagaaaaacttggaaacaacccagtctcaaaaggtttactaatattcgatgcatctagttcctggggaccacagatgtctgcttcagttcatttggactccaaaaagaaacagcatttgtttgtcaaagaagtcaagattgatgggcagttcagagtctcttcgttctatgctaaaggcacatatggcctgtcttgtcagagggatcctaacactggccggctcaatggagagtccaacctgaggtttaactcctcctacctccaaggcaccaaccagataacaggaagatatgaagatggaaccctctccctcacctccacctctgatctgcaaagtggcatcattaaaaatactgcttccctaaagtatgagaactacgagctgactttaaaatctgacaccaatgggaagtataagaactttgccacttctaacaagatggatatgaccttctctaagcaaaatgcactgctgcgttctgaatatcaggctgattacgagtcattgaggttcttcagcctgctttctggatcactaaattcccatggtcttgagttaaatgctgacatcttaggcactgacaaaattaatagtggtgctcacaaggcgacactaaggattggccaagatggaatatctaccagtgcaacgaccaacttgaagtgtagtctcctggtgctggagaatgagctgaatgcagagcttggcctctctggggcatctatgaaattaacaacaaatggccgcttcagggaacacaatgcaaaattcagtctggatgggaaagccgccctcacagagctatcactgggaagtgcttatcaggccatgattctgggtgtcgacagcaaaaacattttcaacttcaaggtcagtcaagaaggacttaagctctcaaatgacatgatgggctcatatgctgaaatgaaatttgaccacacaaacagtctgaacattgcaggcttatcactggacttctcttcaaaacttgacaacatttacagctctgacaagttttataagcaaactgttaatttacagctacagccctattctctggtaactactttaaacagtgacctgaaatacaatgctctggatctcaccaacaatgggaaactacggctagaacccctgaagctgcatgtggctggtaacctaaaaggagcctaccaaaataatgaaataaaacacatctatgccatctcttctgctgccttatcagcaagctataaagcagacactgttgctaaggttcagggtgtggagtttagccatcggctcaacacagacatcgctgggctggcttcagccattgacatgagcacaaactataattcagactcactgcatttcagcaatgtcttccgttctgtaatggccccgtttaccatgaccatcgatgcacatacaaatggcaatgggaaactcgctctctggggagaacatactgggcagctgtatagcaaattcctgttgaaagcagaacctctggcatttactttctctcatgattacaaaggctccacaagtcatcatctcgtgtctaggaaaagcatcagtgcagctcttgaacacaaagtcagtgccctgcttactccagctgagcagacaggcacctggaaactcaagacccaatttaacaacaatgaatacagccaggacttggatgcttacaacactaaagataaaattggcgtggagcttactggacgaactctggctgacctaactctactagactccccaattaaagtgccacttttactcagtgagcccatcaatatcattgatgctttagagatgagagatgccgttgagaagccccaagaatttacaattgttgcttttgtaaagtatgataaaaaccaagatgttcactccattaacctcccattttttgagaccttgcaagaatattttgagaggaatcgacaaaccattatagttgtactggaaaacgtacagagaaacctgaagcacatcaatattgatcaatttgtaagaaaatacagagcagccctgggaaaactcccacagcaagctaatgattatctgaattcattcaattgggagagacaagtttcacatgccaaggagaaactgactgctctcacaaaaaagtatagaattacagaaaatgatatacaaattgcattagatgatgccaaaatcaactttaatgaaaaactatctcaactgcagacatatatgatacaatttgatcagtatattaaagatagttatgatttacatgatttgaaaatagctattgctaatattattgatgaaatcattgaaaaattaaaaagtcttgatgagcactatcatatccgtgtaaatttagtaaaaacaatccatgatctacatttgtttattgaaaatattgattttaacaaaagtggaagtagtactgcatcctggattcaaaatgtggatactaagtaccaaatcagaatccagatacaagaaaaactgcagcagcttaagagacacatacagaatatagacatccagcacctagctggaaagttaaaacaacacattgaggctattgatgttagagtgcttttagatcaattgggaactacaatttcatttgaaagaataaatgatgttcttgagcatgtcaaacactttgttataaatcttattggggattttgaagtagctgagaaaatcaatgccttcagagccaaagtccatgagttaatcgagaggtatgaagtagaccaacaaatccaggttttaatggataaattagtagagttggcccaccaatacaagttgaaggagactattcagaagctaagcaatgtcctacaacaagttaagataaaagattactttgagaaattggttggatttattgatgatgctgtcaagaagcttaatgaattatcttttaaaacattcattgaagatgttaacaaattccttgacatgttgataaagaaattaaagtcatttgattaccaccagtttgtagatgaaaccaatgacaaaatccgtgaggtgactcagagactcaatggtgaaattcaggctctggaactaccacaaaaagctgaagcattaaaactgtttttagaggaaaccaaggccacagttgcagtgtatctggaaagcctacaggacaccaaaataaccttaatcatcaattggttacaggaggctttaagttcagcatctttggctcacatgaaggccaaattccgagagactctagaagatacacgagaccgaatgtatcaaatggacattcagcaggaacttcaacgatacctgtctctggtaggccaggtttatagcacacttgtcacctacatttctgattggtggactcttgctgctaagaaccttactgactttgcagagcaatattctatccaagattgggctaaacgtatgaaagcattggtagagcaagggttcactgttcctgaaatcaagaccatccttgggaccatgcctgcctttgaagtcagtcttcaggctcttcagaaagctaccttccagacacctgattttatagtccccctaacagatttgaggattccatcagttcagataaacttcaaagacttaaaaaatataaaaatcccatccaggttttccacaccagaatttaccatccttaacaccttccacattccttcctttacaattgactttgtagaaatgaaagtaaagatcatcagaaccattgaccagatgctgaacagtgagctgcagtggcccgttccagatatatatctcagggatctgaaggtggaggacattcctctagcgagaatcaccctgccagacttccgtttaccagaaatcgcaattccagaattcataatcccaactctcaaccttaatgattttcaagttcctgaccttcacataccagaattccagcttccccacatctcacacacaattgaagtacctacttttggcaagctatacagtattctgaaaatccaatctcctcttttcacattagatgcaaatgctgacatagggaatggaaccacctcagcaaacgaagcaggtatcgcagcttccatcactgccaaaggagagtccaaattagaagttctcaattttgattttcaagcaaatgcacaactctcaaaccctaagattaatccgctggctctgaaggagtcagtgaagttctccagcaagtacctgagaacggagcatgggagtgaaatgctgttttttggaaatgctattgagggaaaatcaaacacagtggcaagtttacacacagaaaaaaatacactggagcttagtaatggagtgattgtcaagataaacaatcagcttaccctggatagcaacactaaatacttccacaaattgaacatccccaaactggacttctctagtcaggctgacctgcgcaacgagatcaagacactgttgaaagctggccacatagcatggacttcttctggaaaagggtcatggaaatgggcctgccccagattctcagatgagggaacacatgaatcacaaattagtttcaccatagaaggacccctcacttcctttggactgtccaataagatcaatagcaaacacctaagagtaaaccaaaacttggtttatgaatctggctccctcaacttttctaaacttgaaattcaatcacaagtcgattcccagcatgtgggccacagtgttctaactgctaaaggcatggcactgtttggagaagggaaggcagagtttactgggaggcatgatgctcatttaaatggaaaggttattggaactttgaaaaattctcttttcttttcagcccagccatttgagatcacggcatccacaaacaatgaagggaatttgaaagttcgttttccattaaggttaacagggaagatagacttcctgaataactatgcactgtttctgagtcccagtgcccagcaagcaagttggcaagtaagtgctaggttcaatcagtataagtacaaccaaaatttctctgctggaaacaacgagaacattatggaggcccatgtaggaataaatggagaagcaaatctggatttcttaaacattcctttaacaattcctgaaatgcgtctaccttacacaataatcacaactcctccactgaaagatttctctctatgggaaaaaacaggcttgaaggaattcttgaaaacgacaaagcaatcatttgatttaagtgtaaaagctcagtataagaaaaacaaacacaggcattccatcacaaatcctttggctgtgctttgtgagtttatcagtcagagcatcaaatcctttgacaggcattttgaaaaaaacagaaacaatgcattagattttgtcaccaaatcctataatgaaacaaaaattaagtttgataagtacaaagctgaaaaatctcacgacgagctccccaggacctttcaaattcctggatacactgttccagttgtcaatgttgaagtgtctccattcaccatagagatgtcggcattcggctatgtgttcccaaaagcagtcagcatgcctagtttctccatcctaggttctgacgtccgtgtgccttcatacacattaatcctgccatcattagagctgccagtccttcatgtccctagaaatctcaagctttctcttccagatttcaaggaattgtgtaccataagccatatttttattcctgccatgggcaatattacctatgatttctcctttaaatcaagtgtcatcacactgaataccaatgctgaactttttaaccagtcagatattgttgctcatctcctttcttcatcttcatctgtcattgatgcactgcagtacaaattagagggcaccacaagattgacaagaaaaaggggattgaagttagccacagctctgtctctgagcaacaaatttgtggagggtagtcataacagtactgtgagcttaaccacgaaaaatatggaagtgtcagtggcaacaaccacaaaagcccaaattccaattttgagaatgaatttcaagcaagaacttaatggaaataccaagtcaaaacctactgtctcttcctccatggaatttaagtatgatttcaattcttcaatgctgtactctaccgctaaaggagcagttgaccacaagcttagcttggaaagcctcacctcttacttttccattgagtcatctaccaaaggagatgtcaagggttcggttctttctcgggaatattcaggaactattgctagtgaggccaacacttacttgaattccaagagcacacggtcttcagtgaagctgcagggcacttccaaaattgatgatatctggaaccttgaagtaaaagaaaattttgctggagaagccacactccaacgcatatattccctctgggagcacagtacgaaaaaccacttacagctagagggcctctttttcaccaacggagaacatacaagcaaagccaccctggaactctctccatggcaaatgtcagctcttgttcaggtccatgcaagtcagcccagttccttccatgatttccctgaccttggccaggaagtggccctgaatgctaacactaagaaccagaagatcagatggaaaaatgaagtccggattcattctgggtctttccagagccaggtcgagctttccaatgaccaagaaaaggcacaccttgacattgcaggatccttagaaggacacctaaggttcctcaaaaatatcatcctaccagtctatgacaagagcttatgggatttcctaaagctggatgtaaccaccagcattggtaggagacagcatcttcgtgtttcaactgcctttgtgtacaccaaaaaccccaatggctattcattctccatccctgtaaaagttttggctgataaattcattattcctgggctgaaactaaatgatctaaattcagttcttgtcatgcctacgttccatgtcccatttacagatcttcaggttccatcgtgcaaacttgacttcagagaaatacaaatctataagaagctgagaacttcatcatttgccctcaacctaccaacactccccgaggtaaaattccctgaagttgatgtgttaacaaaatattctcaaccagaagactccttgattcccttttttgagataaccgtgcctgaatctcagttaactgtgtcccagttcacgcttccaaaaagtgtttcagatggcattgctgctttggatctaaatgcagtagccaacaagatcgcagactttgagttgcccaccatcatcgtgcctgagcagaccattgagattccctccattaagttctctgtacctgctggaattgccattccttcctttcaagcactgactgcacgctttgaggtagactctcccgtgtataatgccacttggagtgccagtttgaaaaacaaagcagattatgttgaaacagtcctggattccacatgcagctcaaccgtacagttcctagaatatgaacttaatgttttgggaacacacaaaatcgaagatggtacgttagcctctaagactaaaggaacatttgcacaccgtgacttcagtgcagaatatgaagaagatggcaaatatgaaggacttcaggaatgggaaggaaaagcgcacctcaatatcaaaagcccagcgttcaccgatctccatctgcgctaccagaaagacaagaaaggcatctccacctcagcagcctccccagccgtaggcaccgtgggcatggatatggatgaagatgacgacttttctaaatggaacttctactacagccctcagtcctctccagataaaaaactcaccatattcaaaactgagttgagggtccgggaatctgatgaggaaactcagatcaaagttaattgggaagaagaggcagcttctggcttgctaacctctctgaaagacaacgtgcccaaggccacaggggtcctttatgattatgtcaacaagtaccactgggaacacacagggctcaccctgagagaagtgtcttcaaagctgagaagaaatctgcaggaccatgctgagtgggtttatcaaggggccattagggaaattgatgatatcgacgagaggttccagaaaggagccagtgggaccactgggacctaccaagagtggaaggacaaggcccagaatctgtaccaggaactgttgactcaggaaggccaagccagtttccagggactcaaggataacgtgtttgatggcttggtacgagttactcaagaattccatatgaaagtcaagcatctgattgactcactcattgattttctgaacttccccagattccagtttccggggaaacctgggatatacactagggaggaactttgcactatgttcataagggaggtagggacggtactgtcccaggtatattcgaaagtccataatggttcagaaatactgttttcctatttccaagacctagtgattacacttcctttcgagttaaggaaacataaactaatagatgtaatctcgatgtatagggaactgttgaaagatttatcaaaagaagcccaagaggtatttaaagccattcagtctctcaagaccacagaggtgctacgtaatcttcaggaccttttacaattcattttccaactaatagaagataacattaaacagctgaaagagatgaaatttacttatcttattaattatatccaagatgagatcaacacaatcttcaatgattatatcccatatgtttttaaattgttgaaagaaaacctatgccttaatcttcataagttcaatgaatttattcaaaacgagcttcaggaagcttctcaagagttacagcagatccatcaatacattatggcccttcgtgaagaatattttgatccaagtatagttggctggacagtgaaatattatgaacttgaagaaaagatagtcagtctgatcaagaacctgttagttgctcttaaggacttccattctgaatatattgtcagtgcctctaactttacttcccaactctcaagtcaagttgagcaatttctgcacagaaatattcaggaatatcttagcatccttaccgatccagatggaaaagggaaagagaagattgcagagctttctgccactgctcaggaaataattaaaagccaggccattgcgacgaagaaaataatttctgattaccaccagcagtttagatataaactgcaagatttttcagaccaactctctgattactatgaaaaatttattgctgaatccaaaagattgattgacctgtccattcaaaactaccacacatttctgatatacatcacggagttactgaaaaagctgcaatcaaccacagtcatgaacccctacatgaagcttgctccaggagaacttactatcatcctctaattttttaaaagaaatcttcatttattcttcttttccaattgaactttcacatagcacagaaaaaattcaaaatgcctatattgatcaaaccatacagtgagccagccttgcagtaggcagtagactataagcagaagcacatatgaactggacctgcaccaaagctggcaccagggctcggaaggtctctgaactcagaaggatggcattttttgcaagttaaagaaaatcaggatctgagttattttgctaaacttgggggaggaggaacaaataaatggagtctttattgtgtatcat

SEQ ID NO: 70 - protein, 4563 aa, Homo sapiens [sequence omitted]

SEQ ID NO: 71 - DNA, 1156 bp, Homo sapiens
  CDS (61)..(1014)
cgcagcggaggtgaaggacgtccttccccaggagccgactggccaatcacaggcaggaagatgaaggttctgtgggctgcgttgctggtcacattcctggcaggatgccaggccaaggtggagcaagcggtggagacagagccggagcccgagctgcgccagcagaccgagtggcagagcggccagcgctgggaactggcactgggtcgcttttgggattacctgcgctgggtgcagacactgtctgagcaggtgcaggaggagctgctcagctcccaggtcacccaggaactgagggcgctgatggacgagaccatgaaggagttgaaggcctacaaatcggaactggaggaacaactgaccccggtggcggaggagacgcgggcacggctgtccaaggagctgcaggcggcgcaggcccggctgggcgcggacatggaggacgtgtgcggccgcctggtgcagtaccgcggcgaggtgcaggccatgctcggccagagcaccgaggagctgcgggtgcgcctcgcctcccacctgcgcaagctgcgtaagcggctcctccgcgatgccgatgacctgcagaagcgcctggcagtgtaccaggccggggcccgcgagggcgccgagcgcggcctcagcgccatccgcgagcgcctggggcccctggtggaacagggccgcgtgcgggccgccactgtgggctccctggccggccagccgctacaggagcgggcccaggcctggggcgagcggctgcgcgcgcggatggaggagatgggcagccggacccgcgaccgcctggacgaggtgaaggagcaggtggcggaggtgcgcgccaagctggaggagcaggcccagcagatacgcctgcaggccgaggccttccaggcccgcctcaagagctggttcgagcccctggtggaagacatgcagcgccagtgggccgggctggtggagaaggtgcaggctgccgtgggcaccagcgccgcccctgtgcccagcgacaatcactgaacgccgaagcctgcagccatgcgaccccacgccaccccgtgcctcctgcctccgcgcagcctgcagcgggagaccctgtccccgccccagccgtcctcctggggtggaccctagtttaataaagattcaccaagtttcacgc

SEQ ID NO: 72 - protein, 317 aa, Homo sapiens [sequence omitted]

SEQ ID NO: 73 - DNA, 542 bp, Homo sapiens
  CDS (3)..(542)
ctctgggcgacgttgctggcagaggaaatgagaagaagcccagtagcgtgagggctctgtccattgtcctccccatcgccacggagctgggtctctggtctcgggggcagctgtgtgacagagcgtgcctctccctacggtgctcctcgtcttcctttgcctgggggtcttccttctatggaagaactggcggcttaagaacatcaacagcatcaactttgacaaccccgtctatcagaagaccacagaggatgaggtccacatttgccacaaccaggacggctacagctacccctcgagacagatggtcagtctggaggatgacgtggcgtgaacatctgcctggagtcccgcccctgcccagaacccttcctgagacctcgccggccttgttttattcaaagacagagaagaccaaagcattgcctgccagagctttgttttatatatttattcatctgggaggcagaacaggcttcggacagtgcccatgcaatggcttgggttgggattttggtttcttcctttcctgtgaaggataa

SEQ ID NO: 74 - protein, 179 aa, Homo sapiens
LGDVAGRGNEKKPSSVRALSIVLPIATELGLWSRGQLCDRACLSLRCSSSSFAWGSSFYGRTGGLRTSTASTLTTPSIRRPQRMRSTFATTRTATATPRDRWSVWRMTWREHLPGVPPLPRTLPETSPALFYSKTEKTKALPARALFYIFIHLGGRTGFGQCPCNGLGWDFGFFLSCEG

SEQ ID NO: 75 - DNA, 3408 bp, Homo sapiens
  CDS (27)..(2519)
cgagcgctcccaccgagctgcctgccatggggctggggctgctgctcccgctgctgctgctctggactcgggggactcaggggtccgagctggaccccaaagggcagcacgtctgtgtggccagcagcccctctgctgagctgcagtgctgcgcaggctggaggcagaaggatcaagaatgcaccatccccatctgtgaggggccggacgcctgccagaaagacgaggtgtgtgtgaagccgggcctctgtcgatgcaagcctggattctttggggcccactgcagctcccgctgcccgggccagtactggggccccgactgccgtgagagctgcccctgccacccgcacggccagtgcgagccagccacgggcgcgtgccagtgccaggccgaccgctggggagcccgctgcgagttcccgtgcgcctgcggcccccacgggcgctgcgaccccgcgaccggcgtgtgccactgcgaacccggctggtggtcgtccacgtgccgccgcccgtgccagtgcaacaccgcggcggcgcgctgcgagcaggccacgggcgcctgcgtgtgcaagccgggctggtgggggcgccgctgcagcttccgctgcaactgccacggctccccgtgcgagcaggactccggccgctgcgcctgccggccgggctggtggggtcccgaatgccagcagcagtgcgagtgtgtgcggggccgctgcagcgccgcctccggcgagtgcacctgcccgcccggcttccgcggagcgcgctgcgagctgccctgcccggcaggcagccacggggtgcagtgcgcacacagctgtggccgctgcaaacacaatgagccgtgctctccagacacaggcagctgtgagtcctgcgagccgggctggaacgggacccagtgccagcagccctgcctgcctggcacctttggcgagagctgcgaacagcagtgccctcactgccgacatggggaggcctgtgagccagatactggccactgtcagcgctgtgaccctggctggctggggcccaggtgtgaagacccctgccccactggtacctttggggaagactgtggctctacctgccccacctgtgttcaggggtcctgtgatactgtgacaggggactgtgtctgcagtgccggctactgggggcccagctgcaacgcctcctgcccagccggtttccatggaaacaactgctcagttccttgtgaatgcccagagggactctgccaccctgtctctgggtcctgccagccaggctctggcagtcgggacactgccctcatcgtgggcagccttgtgcctctgctgctgctcttcctgggtcttgcctgctgtgcctgctgctgctgggccccccgatcagacctcaaggacaggccagcgagagatggagctaccgtgtccaggatgaagctgcaggtctgggggacactgaccagcttgggctccacgctgccctgccgttccctcagctcccacaagctaccctgggtgacagtctcacatcacgacccggaggtccccttcaaccacagcttcatcgagccgccctctgccggctgggccactgatgactccttctcatccgatcctgagtctggagaggcagatgaggttcctgcctactgtgtgccaccccaagaagggatggtccctgtggcccaggcagggtcgtcagaggccagcctggctgcaggtgctttcccgccccctgaggacgcctccacgccattcgccatcccgcgcacctccagcctagctcgggccaagcggccatcggtctccttcgcggaaggtaccaagtttgcaccacagagtcgccgaagctcaggggagctctccagcccgctccgaaagcccaagaggctctcccggggggcgcagtcgggtcctgagggccgggaagccgaagagtccacaggcccagacgaagcagaagcccccgagtcctttccggcggctgccagtcccggggattcagccactggccaccggcggcccccacttggtagccggacagtggctgagcacgtggaagccattgagggcagcgtccaggagagctcgggccctgtgaccacgatctacatgctggcagggaagccccgcggatccgaaggccctgtccgctctgtcttccgccattttggtagcttccagaaaggccaggcggaagccaaggtcaagagggccatccctaagcctccgcgccaggccctgaatcggaaaaagggcagccctggccttgcctctggctctgtcggccagagccccaactcagccccaaaagctgggcttcctggggccacagggcctatggcagtcagaccagaggaagcggtccgggggctgggggctggcaccgagagttcaaggagagcccaggagccagtctctggctgtggctccccagaacaggatccccagaagcaggctgaagaggaaaggcaggaggaacctgagtatgagaatgttgtacccatctccaggccaccagaaccctgatgaccttgaatttggggagtggggagagtggatggactagactgtgctgtgtgctggaaaatgatcccggggccaggacagacaaaccagagcctctgcgcctccacagggaaaaggcaaggcttccaggccagttggcccaggcccctggcagtgctcccggaggggcccaggaaggcctgggcagagaccctgtaggatggggtcaggaagggttgcctgcagggacttttgctctgctgtcctggaccctgtgtgcctcataagggctattctttctttcacgtgcaaaacatttttctgaaatagcaaacaacctacatgtttgctgataaaagattggctaaacaaaattttttttttttttgagacagaatctccctctgtcccccaggctggagtgcagtggtgcgatctcggctcactgcaagctctgcctcccgggttcacgcccttctcctgcctcagcctcccgagtagctgggactacaggtgccctccaccacgcttggctaatttttttgtatatttaatagagacagggtttcaccatgttagccaggatggtctcgatctcctgacctcgtgatccacctgcctcggcctccccaaagtgctgggatgacaggcatgagccaccacgcctggtctatgaactttttaaaaaggatgtatgtgtataaacagattcaagggaaaggcactaaatggttttttcctctggaagatgagattgtaggtgatatttattttcttctgaaacttttgtatagtttgcaaattttctacagtgaacattcttttttacttttgttactagattgaatttgataaagtataataaaaagcaatgatctttgttaaaaaataaaaagtactaacattacag

SEQ ID NO: 76 - protein, 830 aa, Homo sapiens
MGLGLLLPLLLLWTRGTQGSELDPKGQHVCVASSPSAELQCCAGWRQKDQECTIPICEGPDACQKDEVCVKPGLCRCKPGFFGAHCSSRCPGQYWGPDCRESCPCHPHGQCEPATGACQCQADRWGARCEFPCACGPHGRCDPATGVCHCEPGWWSSTCRRPCQCNTAAARCEQATGACVCKPGWWGRRCSFRCNCHGSPCEQDSGRCACRPGWWGPECQQQCECVRGRCSAASGECTCPPGFRGARCELPCPAGSHGVQCAHSCGRCKHNEPCSPDTGSCESCEPGWNGTQCQQPCLPGTFGESCEQQCPHCRHGEACEPDTGHCQRCDPGWLGPRCEDPCPTGTFGEDCGSTCPTCVQGSCDTVTGDCVCSAGYWGPSCNASCPAGFHGNNCSVPCECPEGLCHPVSGSCQPGSGSRDTALIVGSLVPLLLLFLGLACCACCCWAPRSDLKDRPARDGATVSRMKLQVWGTLTSLGSTLPCRSLSSHKLPWVTVSHHDPEVPFNHSFIEPPSAGWATDDSFSSDPESGEADEVPAYCVPPQEGMVPVAQAGSSEASLAAGAFPPPEDASTPFAIPRTSSLARAKRPSVSFAEGTKFAPQSRRSSGELSSPLRKPKRLSRGAQSGPEGREAEESTGPDEAEAPESFPAAASPGDSATGHRRPPLGSRTVAEHVEAIEGSVQESSGPVTTIYMLAGKPRGSEGPVRSVFRHFGSFQKGQAEAKVKRAIPKPPRQALNRKKGSPGLASGSVGQSPNSAPKAGLPGATGPMAVRPEEAVRGLGAGTESSRRAQEPVSGCGSPEQDPQKQAEEERQEEPEYENVVPISRPPEP

SEQ ID NO: 77 - DNA, 4503 bp, Caenorhabditis elegans
  CDS (1)..(4503)
atgaagttcattggaacttccggttcaattacattgggagcagacatcatatgtcggattggttgtcagttcaattatcaagcatctgcaacctgcaattctgttggggcgtctgtcgcaactgtagtcaccgctgataatcctcgacgttcagtgtctttccctatttattgtgcaagcttagcatatgcaagcagtaaatacaacaatatctcgtcagaaacagtcggaatcgcccatctggaacatagacaatcccttgcgaaagacttcacgtgttccaatgcgagccaagaaacatttggacaaagaagttttgttattcttgctgaaaacacaaaagacactgatgtgatgaaaagttccgtggataacgttttcagaaacaagaatagtatcttctaccagcttagtccttttgtcaactctgctcctccacagcgatatgcaaactttttcgctgttctgaataaatgttccgaaactgcacaaacggagcaaagctctgactatggaacgtttttaacaaaagttatgaatgttactagtaaatcacaacaacgacccaatgatccaagtgatcctgtcaaggtcacaaatttcctgcctcaagcaattgcaggagcgaacgcctattctgacattctgcttgtgattaattataacgtgtctaccattaccgacaacgatgctaccgaaatcaaaagtgcattagaaaaacaaagatctcgactatacattctttttgttcaaacgtatttcaactacactgatacttactatgccatgaacaaactggcgattgcgagtggaggagtggcgattcgagtgaacacttatgatgatttgagcacgttctttgcacaatacttcccacttctcgttgcaaatgacattgtcgcaaaagcatatgctgaaaacccaagacctggagttgcgttgaataatgtcaatctacttgctcaacaatatgttcttcttgtaacaaatgaggattcattgggagatggcccggtgccagcatcggtaactgttaccgggattaatgttacacaactaccaacaattggcgaacttcaattattcactcttattccagaaaaggctggaaaattcactccattgttctattcatcttcatcttttgatgacgggtcaaaaattaccattacatacagtgatgcaacaaacccagcaaatccaatttataatggaaatattacgtctgctttaaatgactgcaaatattatgcaaacacaaaaaattacgcctgggcctgtagtatttccgaaatcgcattattattacaattttcaatgagaaatattcagatcgatagagttttgaacggtgaaacgatttcgagaaccttcccaattacttgccttggagcagatgtaggagactgcctcaacggtggaaatctaacagatgctggttcatgcatttgcccattacagtggacaggaactaactgtcaagctccgcaatgcttgaatggaggtacactgaaaactgatgacacttgtgcatgtctcgatagtttcaaaggagatttttgtgaaacaagtacctctgtttgcgctggagctccgacatctccggactatcgctctgaactgagttcattggtaattgttgctgatgtcaacgcattatcaacaagtagtctaagcaatacggtacccggaataactggagtgccaattactgtcattctatatggcgatggaaatgctccaagaattgttcagtctacaactaacagtgagcatctctccgaggtattaggtgcaccgacgggtaccacaacttcaccaagttcaacggcttcaccagcaccatccgcaagtgatatgtataaggctctgaatttggcacttgacaatcagctcaccgaccgtgcatttgtaattgtatacacatcaaattccaatgtcaccattgatcctgactttttgatccgtttggcagtcagaagagccgaagtacgagtgttgtcaacttcgggaactgaaagtcaaaactctataacattatcgctagtcggaaatggaattcctattgcgataaatggcgcgaaagatttcgaaaattacctgacatactacgttgttcccttattccaatcactacaataccaagtgaacactccacaacgagtgttcaatgtgttccaaacaggtcaattctacaactctacgcaaatttctatcccagcagattccacatttgataacgctaaaccaaatctttttgtgcatgtgtacgaaggtcgcattaattattcagatccttcaacaaatggaaacgaggttggcaattctactatatactttctcccttatgaccccacaaaacctatcaacttaattgtgaataataatggcacgaccggttactacgcaatcgaagtcatcggatatctaaagacatcatatggtttcaatattgataatgctaacggatcaaatgaaaacctgaactcgggagtagtatataaccaacaaaacacattgaatatctattctgcgccgttttcacagcttcctaaaactgatccatcaaacttcccatatctcacacttggagaaattgccagtaacggaacagttttacctgcaacaacagttttgtttacaagaaaaagtggtgcgtcctgtttttacagtcacttcaccgttcttgatgtctgctcccaaagcacaacaattggatatcaggcacagttgaccacaagaacaagcaccttgacaaataggattcaacaatttgtgctgacatgctttaaaacaagttatgcaaataatgatacttcctgccatggacatggatcaccaatggcaacctgtgcctgtaatgctgacttcggaggaattgattgcactgaaccggcttgtgtaaatggaggtgttcgggatgggtcggtttgtcgttgtcctgtaagattctatgggcttcgatgtgaagaatgtgagtctaggcaaaatctgcctataagaaaattatccacacctaattacggacaaattactgacaaattactggtaaagaaattcattcagttcccttttgaatcagaaccagcttcgtctactgtctccgtgataacttcaactactatgctgccttctacgtcaactgttgctccaagcacaagccaatcaacaatagtttccactgttactacacagtcaccaagtccttcaacaacagctccaaaacaagtccgagctgctgcattcattattgactgcatgggaactgatgattatgctttcaatcagacattcaaatcgattgcacagtacttcaagacatttggctatagccattacatcatgttaaccaataatttgaatggaagtttacaattgaacaatggaagtttactatttgaagatttccaacaatattcagatgagagtatgattatgagcaaactacccctgtattggagtttaagagccaccccaagtagaaccgctagcgtcagcaacgcgctcagtaagattcttgcaagttacaatagaaacggtacagagttcaaaaactctgtaagcatgaatattttttatgcaactcaaatagggctgggcgatgaggatccaactgcagcaggcttagaagttttcaacaagagcgcgattgtatattctgcattcgcaaaaaatgccaaccagacaattgtgacttctcttcaaaaattcagtaccgacgtaaccactgctagagattattacagtggtctttctgatatgtatgaaagcactcaaccccagggttcgaatgagctccctccaaaaccggatcaacttagttgtgtgtacggcctgcaatcgaatatcaaaattgcaattgatagatccaactcgtcaaacccagaggttaacacaattatgaataatttccttgtcaatttccgtcttggatttaattatattgaaaatgatgacaacagatgcggggataagttaccagaattttataccggacgaactgcattaacggcgttcccgtattatgatgccattgcaaaaatagcaacattttgtccatctcaatacacttcgatgctatcattccaagtcgtcggaagccaattacagccaaacttcaccgataaatatgtcaaagtcattagcaagaacattaacagtgccgattgttcgtgcaacagattcaacgacactaacactgcgaagtttatcatttggatgcctcgttctgcagcgcccgtcactgatgatgattatttaaccttgctcaaactcaacaccacaaatgcatatcactttgtcgttccattttacgatagtgctgataacagtaccgatttgtactaccagattcttgtgaagcaagcaggacccgaaggtcccgattattattggttaccaaatgcagttaatgctacaaatttgcaaacgaatgtaataaatattctatacgagaagctttgccaaactgccggtgttgacccaacagcaatcccaccataa

SEQ ID NO: 78 - protein, 1500 aa, Caenorhabditis elegans
MKFIGTSGSITLGADIICRIGCQFNYQASATCNSVGASVATVVTADNPRRSVSFPIYCASLAYASSKYNNISSETVGIAHLEHRQSLAKDFTCSNASQETFGQRSFVILAENTKDTDVMKSSVDNVFRNKNSIFYQLSPFVNSAPPQRYANFFAVLNKCSETAQTEQSSDYGTFLTKVMNVTSKSQQRPNDPSDPVKVTNFLPQAIAGANAYSDILLVINYNVSTITDNDATEIKSALEKQRSRLYILFVQTYFNYTDTYYAMNKLAIASGGVAIRVNTYDDLSTFFAQYFPLLVANDIVAKAYAENPRPGVALNNVNLLAQQYVLLVTNEDSLGDGPVPASVTVTGINVTQLPTIGELQLFTLIPEKAGKFTPLFYSSSSFDDGSKITITYSDATNPANPIYNGNITSALNDCKYYANTKNYAWACSISEIALLLQFSMRNIQIDRVLNGETISRTFPITCLGADVGDCLNGGNLTDAGSCICPLQWTGTNCQAPQCLNGGTLKTDDTCACLDSFKGDFCETSTSVCAGAPTSPDYRSELSSLVIVADVNALSTSSLSNTVPGITGVPITVILYGDGNAPRIVQSTTNSEHLSEVLGAPTGTTTSPSSTASPAPSASDMYKALNLALDNQLTDRAFVIVYTSNSNVTIDPDFLIRLAVRRAEVRVLSTSGTESQNSITLSLVGNGIPIAINGAKDFENYLTYYVVPLFQSLQYQVNTPQRVFNVFQTGQFYNSTQISIPADSTFDNAKPNLFVHVYEGRINYSDPSTNGNEVGNSTIYFLPYDPTKPINLIVNNNGTTGYYAIEVIGYLKTSYGFNIDNANGSNENLNSGVVYNQQNTLNIYSAPFSQLPKTDPSNFPYLTLGEIASNGTVLPATTVLFTRKSGASCFYSHFTVLDVCSQSTTIGYQAQLTTRTSTLTNRIQQFVLTCFKTSYANNDTSCHGHGSPMATCACNADFGGIDCTEPACVNGGVRDGSVCRCPVRFYGLRCEECESRQNLPIRKLSTPNYGQITDKLLVKKFIQFPFESEPASSTVSVITSTTMLPSTSTVAPSTSQSTIVSTVTTQSPSPSTTAPKQVRAAAFIIDCMGTDDYAFNQTFKSIAQYFKTFGYSHYIMLTNNLNGSLQLNNGSLLFEDFQQYSDESMIMSKLPLYWSLRATPSRTASVSNALSKILASYNRNGTEFKNSVSMNIFYATQIGLGDEDPTAAGLEVFNKSAIVYSAFAKNANQTIVTSLQKFSTDVTTARDYYSGLSDMYESTQPQGSNELPPKPDQLSCVYGLQSNIKIAIDRSNSSNPEVNTIMNNFLVNFRLGFNYIENDDNRCGDKLPEFYTGRTALTAFPYYDAIAKIATFCPSQYTSMLSFQVVGSQLQPNFTDKYVKVISKNINSADCSCNRFNDTNTAKFIIWMPRSAAPVTDDDYLTLLKLNTTNAYHFVVPFYDSADNSTDLYYQILVKQAGPEGPDYYWLPNAVNATNLQTNVINILYEKLCQTAGVDPTAIPP

SEQ ID NO: 79 - DNA, 369 bp, Homo sapiens
  CDS (89)..(268)
gtattaagctcaatattagcattaatccatttatttgttaaaatctaatattgtattcttgtcttaaacagtgactttgtttttgtaggctgcatcccatatctatcaaaatcaatttgttcaaatgatcctcaattcacttattaacaagtcaaaatcttctatgttccaagtcagaactttgagagaactgttatggggctatagggatccatttttgagtttggttccgtaccctgttactaccacagttggtctgttttatcctgtaagtaccaaatatgaatggcaatattattacattttaatttaattaattcaatggcattggcaaggcataattttataatttagctcattagctatgct

SEQ ID NO: 80 - protein, 60 aa, Homo sapiens
AASHIYQNQFVQMILNSLINKSKSSMFQVRTLRELLWGYRDPFLSLVPYPVTTTVGLFYP

SEQ ID NO: 81 - DNA, 3412 bp, Homo sapiens
  CDS (27)..(2519)
cgagcgctcccaccgagctgcctgccatggggctggggctgctgctcccgctgctgctgctctggactcgggggactcaggggtccgagctggaccccaaagggcagcacgtctgtgtggccagcagcccctctgctgagctgcagtgctgcgcaggctggaggcagaaggatcaagaatgcaccatccccatctgtgaggggccggacgcctgccagaaagacgaggtgtgtgtgaagccgggcctctgtcgatgcaagcctggattctttggggcccactgcagctcccgctgcccgggccagtactggggccccgactgccgtgagagctgcccctgccacccgcacggccagtgcgagccagccacgggcgcgtgccagtgccaggccgaccgctggggagcccgctgcgagttcccgtgcgcctgcggcccccacgggcgctgcgaccccgcgaccggcgtgtgccactgcgaacccggctggtggtcgtccacgtgccgccgcccgtgccagtgcaacaccgcggcggcgcgctgcgagcaggccacgggcgcctgcgtgtgcaagccgggctggtgggggcgccgctgcagcttccgctgcaactgccacggctccccgtgcgagcaggactccggccgctgcgcctgccggccgggctggtggggtcccgaatgccagcagcagtgcgagtgtgtgcggggccgctgcagcgccgcctccggcgagtgcacctgcccgcccggcttccgcggagcgcgctgcgagctgccctgcccggcaggcagccacggggtgcagtgcgcacacagctgtggccgctgcaaacacaatgagccgtgctctccagacacaggcagctgtgagtcctgcgagccgggctggaacgggacccagtgccagcagccctgcctgcctggcacctttggcgagagctgcgaacagcagtgccctcactgccgacatggggaggcctgtgagccagatactggccactgtcagcgctgtgaccctggctggctggggcccaggtgtgaagacccctgccccactggtacctttggggaagactgtggctctacctgccccacctgtgttcaggggtcctgtgatactgtgacaggggactgtgtctgcagtgccggctactgggggcccagctgcaacgcctcctgcccagccggtttccatggaaacaactgctcagttccttgtgaatgcccagagggactctgccaccctgtctctgggtcctgccagccaggctctggcagtcgggacactgccctcatcgcgggcagccttgtgcctctgctgctgctcttcctgggccttgcctgctgtgcctgctgctgctgggccccccgatcagacctcaaggacaggccagcgagagatggagctaccgtgtccaggatgaagctgcaggtctgggggacactgaccagcttgggctccacgctgccctgccgttccctcagctcccacaagctaccctgggtgacagtctcacatcacgacccggaggtccccttcaaccacagcttcatcgagccgccctctgccggctgggccactgatgactccttctcatccgatcctgagtctggagaggcagatgaggttcctgcctactgtgtgccaccccaagaagggatggtccctgtggcccaggcagggtcgtcagaggccagcctggctgcaggtgctttcccgccccctgaggacgcctccacgccattcgccatcccgcgcacctccagcctagctcgggccaagcggccatcggtctccttcgcggaaggtaccaagtttgcaccacagagtcgccgaagctcaggggagctctccagcccgctccgaaagcccaagaggctctcccggggggcgcagtcgggtcctgagggccgggaagccgaagagtccacaggcccagaggaagcagaagcccccgagtcctttccggcggctgccagtcccggggattcagccactggccaccggcggcccccacttggtggccggacagtggctgagcacgtggaagccattgagggcagcgtccaggagagctcgggccctgtgaccacgatctacatgctggcagggaagccccgcggatccgaaggccctgtccgctctgtcttccgccattttggtagcttccagaaaggccaggcggaagccaaggtcaagagggccatccctaagcctccgcgccaggccctgaatcggaaaaagggcagccctggccttgcctctggctctgtcggccagagccccaactcagccccaaaagctgggcttcctggggccacagggcctatggcagtcagaccagaggaagcggtccgggggctgggggctggcaccgagagttcaaggagagcccaggagccagtctctggctgtggctccccagaacaggatccccagaagcaggctgaagaggaaaggcaggaggaacctgagtatgagaatgttgtacccatctccaggccaccagaaccctgatgaccttgaatttggggagtggggagagtggatggactagactgtgctgtgtgctggaaaatgatcccggggccaggacagacaaaccagagcctctgcgcctccacagggaaaaggcaaggcttccaggccagttggcccaggcccctggcagtgctcccggaggggcccaggaaggcctgggcagagaccctgtaggatggggtcaggaagggttgcctgcagggacttttgctctgctgtcctggaccctgtgtgcctcataagggctattctttctttcacgtgcaaaacatttttctgaaatagcaaacaacctacatgtttgctgataaaagattggctaaacaaatttttttttttttttttgagacagaatctccctctgtcccccaggctggagtgcagtggtgcgatctcggctcactgcaagctctgcctcccgggttcacgcccttctcctgcctcagcctcccgagtagctgggactacaggtgccctccaccacgcttggctaatttttttgtatatttaatagagacagggtttcaccatgttagccaggatggtctcgatctcctgacctcgtgatccacctgcctcggcctcccaaagtgctgggatgacaggcatgagccaccacgcctggtctatgaactttttaaaaaggatgtatgtgtataaaaacagattcaagggaaaggcactaaatggttttttcctctggaagatgagattgtaggtgatatttattttcttctgaaacttttgtatagtttgcaaattttctacagtgaacattcttttttacttttgttactagattgaatttgataaagtataataaaaagcaatgatctttgttaaaaaaataaaaagtactaacattacag

SEQ ID NO: 82 - protein, 830 aa, Homo sapiens
MGLGLLLPLLLLWTRGTQGSELDPKGQHVCVASSPSAELQCCAGWRQKDQECTIPICEGPDACQKDEVCVKPGLCRCKPGFFGAHCSSRCPGQYWGPDCRESCPCHPHGQCEPATGACQCQADRWGARCEFPCACGPHGRCDPATGVCHCEPGWWSSTCRRPCQCNTAAARCEQATGACVCKPGWWGRRCSFRCNCHGSPCEQDSGRCACRPGWWGPECQQQCECVRGRCSAASGECTCPPGFRGARCELPCPAGSHGVQCAHSCGRCKHNEPCSPDTGSCESCEPGWNGTQCQQPCLPGTFGESCEQQCPHCRHGEACEPDTGHCQRCDPGWLGPRCEDPCPTGTFGEDCGSTCPTCVQGSCDTVTGDCVCSAGYWGPSCNASCPAGFHGNNCSVPCECPEGLCHPVSGSCQPGSGSRDTALIAGSLVPLLLLFLGLACCACCCWAPRSDLKDRPARDGATVSRMKLQVWGTLTSLGSTLPCRSLSSHKLPWVTVSHHDPEVPFNHSFIEPPSAGWATDDSFSSDPESGEADEVPAYCVPPQEGMVPVAQAGSSEASLAAGAFPPPEDASTPFAIPRTSSLARAKRPSVSFAEGTKFAPQSRRSSGELSSPLRKPKRLSRGAQSGPEGREAEESTGPEEAEAPESFPAAASPGDSATGHRRPPLGGRTVAEHVEAIEGSVQESSGPVTTIYMLAGKPRGSEGPVRSVFRHFGSFQKGQAEAKVKRAIPKPPRQALNRKKGSPGLASGSVGQSPNSAPKAGLPGATGPMAVRPEEAVRGLGAGTESSRRAQEPVSGCGSPEQDPQKQAEEERQEEPEYENVVPISRPPEP

SEQ ID NO: 83 - DNA, 3763 bp, Mus musculus
  CDS (48)..(1139)
gaggtcctcgactgtttcagtttttcactcttagcatgaatttggaaatgacttttgatgacaagatgaagcctgcgaatgacgagcctgatcagaagtcatgtggcaagaagcctaaaggtctgcatttgctttcctccccatggtggttccctgctgctatgactctggtcatcctctgcctggtgttgtcagtgacccttattgtacagtggacacaattacgccaggtatctgacctcttaaaacaataccaagcgaaccttactcagcaggatcgtatcctggaagggcagatgttagcccagcagaaggcagaaaacgcttcacaggaatcaaagaaggaactgaaaggaaagatagacaccctcacccagaagctgaatgagaaatccaaagagcaggaggagcttctacagaagaatcagaacctccaagaagccctgcaaagagctgcaaactcttcagaggagtcccagagagaactcaagggaaagatagacaccatcacccggaagctggacgagaaatccaaagagcaggaggagcttctgcagatgattcagaacctccaagaagccctgcagagagctgcaaactcttcagaggagtcccagagagaactcaagggaaagatagacaccctcaccttgaagctgaacgagaaatccaaagagcaggaggagcttctacagaagaatcagaacctccaagaagccctgcaaagagctgcaaacttttcaggtccttgtccacaagactggctctggcataaagaaaactgttacctcttccatgggccctttagctgggaaaaaaaccggcagacctgccaatctttgggtggccagttactacaaattaatggtgcagatgatttgacattcatcttacaagcaatttcccataccacctccccgttctggattggattgcatcggaagaagcctggccaaccatggctatgggagaatggaactcctttgaattttcaattctttaagaccaggggcgtttctttacagctatattcatcaggcaactgtgcataccttcaagacggagctgtgttcgctgaaaactgcattctaattgcattcagcatatgtcagaagaagacaaatcatttgcaaatttagtgaatctaaagattctggagaagaccatgagaagacttttgactgtcgctctgaaatttaagctattttttattacctgcatgtaaagcatgttggccttgacatctgtcagttacctgatagctacagttcacctcatcaaagacaaggaccagaagcaaatactggtggatccagatgtttgaaatctttgtatcaaaacgtgtgagttcaattgtttatccatatacactggccttgcccctccaaagtctcccaaccaacctgcactccttcttcccctttgtgttttaaatgatgcttcctgcctgacctggccatgctttgtactcagtctcctctacctcagtatgcctcctgttgctgcatgaaagacaggatgtagaaatcctcctcaagtgcaggcagagggctcaaaggcaaagctcgtccgagaaataacatgcaaagaaacagaactggaaaaactacactgcaaacaggaactcatgatctctaaaaagccatggcttgatctttatgacaggagtccatctccagactgcacttttacacacatattttttattttacttttattgtgaagtttatggatagtttgcctacttgaattctgtgtaccacatgagtgcctggtgccactgaagatcagaagaggacatcagattctctggatctggaattccagatggttgtaagctgctatgtagatgtgaagaattgaattcggtgtcccctggaagaacagccagtactctttgccatgagctatctctcaagctcctgtgatcaattcttgtatcagttatgtctccatttttgctctaccaaagaacagtgttataactttaaaacagtaagtattttcattattctaggggtaatatagcagatatagatagagatagagatagagatagagatagagatagagatagagatagagatagagatagagataggtataggtataggtataggtataggtataggtataggtataggtataggtataggtagatagagatagaggtagaggtagaggtagaggtagaggtagaggtagaggtagaggtagagatagagatagagatagagatagagatagagatagagatagagatagagatagagatagagatagagatagagatagagatagagatagagatagagatagagatagagatagatagtgtgtgtgtgcgtgtgtgtgtttctatgctaggtacgatccttgaggagatgagacagttttgtgtgaaatgagtttgtaataatccaaatttaaaaataaattcgatgattacctgtagtggtcatattaccacagccaagatgatgaacatacctgtcacttctgccccttcccaaagcctcctccctaaaacaaacaccaatctgctttcagttcgcattttatagagcttctcattttgtttttaagacagaatctcatatagtcctggctggcctggaactcactacacagagcaggctggcctccaccttctagagctcctcctgccagactcccaaaccttaagactgaaggagtgccctgccgtgtgtgactcaaacaccttaatgtgaatggaacagcataagatgtccaggttttttcagtccagcttcttccacttggtacaatttttaatttttgtgttcatacatctccaccacagtgtttgtatcagttcatcattcttttcaaatgttgagccttcccctgtggatctatagtgtcatttgttatctgtgtatttgttgatgccatttgggttggttttgtctggggtcacctacaaataaagctgctatggatgtccatggacaaggctaatatcttaggtaagcacctacgagtaagatgcttgggtcattcagtgtgggaatatatggttggctattttaaccattcctgtttgaaaacattaattttttttatttttgaaatcaattttttaaaaaattaattagtctattttacatctcaaccccagtttctcttcctcctctcctctcaaccttctcccaccttctctccctgaccccatccacccctcctccctttctctccagaagaggggaggcctcccatggatgccaaccagcctcagcatctcaagttacagtaagaataggtttgtcttctcctgtgaaaatcttaatttttagatttatctattatatatgcagtactttgcttgcacatatgtattggtaccatgtacatgcatggtaccagagaaagtcagaagaggccattgtattttctgggactggaattacagacgtttttgaacaatcctatagactctgggaactgaacccaggtcgtctggaaaggcaagcagtgctcttaacccctgagccatttcttctggccttttagcaatttttattaatatataactgtgtatacttgcacttttagctcgaagttcttaagtgtcaaatagtcttggatttattttcatgttatcactgtctgtacaatttctgtgatgaaataactgagcatatattttgagaatttggttttcttaaattttaaatctgaaggatttacatatttgagaataaaaaccagccagatacataaaaaaaaaaaaaaaaaaaaa

SEQ ID NO: 84 - protein, 363 aa, Mus musculus
MTFDDKMKPANDEPDQKSCGKKPKGLHLLSSPWWFPAAMTLVILCLVLSVTLIVQWTQLRQVSDLLKQYQANLTQQDRILEGQMLAQQKAENASQESKKELKGKIDTLTQKLNEKSKEQEELLQKNQNLQEALQRAANSSEESQRELKGKIDTITRKLDEKSKEQEELLQMIQNLQEALQRAANSSEESQRELKGKIDTLTLKLNEKSKEQEELLQKNQNLQEALQRAANFSGPCPQDWLWHKENCYLFHGPFSWEKNRQTCQSLGGQLLQINGADDLTFILQAISHTTSPFWIGLHRKKPGQPWLWENGTPLNFQFFKTRGVSLQLYSSGNCAYLQDGAVFAENCILIAFSICQKKTNHLQI

SEQ ID NO: 85 - DNA, 1102 bp, Homo sapiens
  CDS (44)..(1102)
gcgtcgacgtcttgccaccgcatctggagaaccagcggttaccatggaggggatcagtatatacacttcagataactacaccgaggaaatgggctcaggggactatgactccatgaaggaaccctgtttccgtgaagaaaatgctaatttcaataaaatcttcctgcccaccatctactccatcatcttcttaactggcattgtgggcaatggattggtcatcctggtcatgggttaccagaagaaactgagaagcatgacggacaagtacaggctgcacctgtcagtggccgacctcctctttgtcatcacgcttcccttctgggcagttgatgccgtggcaaactggtactttgggaacttcctatgcaaggcagtccatgtcatctacacagtcaacctctacagcagtgtcctcatcctggccttcatcagtctggaccgctacctggccattgtccacgccaccaacagtcagaggccaaggaagctgttggctgaaaaggtggtctatgttggcgtctggatccctgccctcctgctgactattcccgacttcatctttgccaacgtcagtgaggcagatgacagatatatctgtgaccgcttctaccccaatgacttgtgggtggttgtgttccagtttcagcacatcatggttggccttatcctgcctggtattgtcatcctgtcctgctattgcattatcatctccaagctgtcacactccaagggccaccagaagcgcaaggccctcaagaccacaatcatccccatcctggctttcttcgcctgttggctgccttactacattgggatcagcatcgactccttcatcctcctggaaatcatcaagcaagggtgtgagtttgagaacactgtgcacaagtggatttccatcaccgaggccctagctttcttccactgttgtctgaaccccatcctctatgctttccttggagccaaatttaaaacctctgcccagcacgcactcacctctgtgagcagagggtccagcctcaagatcctctccaaaggaaagcgaggtggacattcatctgtttccactgagtctgagtcttcaagttttcactccagctaa

SEQ ID NO: 86 - protein, 352 aa, Homo sapiens [sequence omitted]

SEQ ID NO: 87 - DNA, 25 bp, Artificial sequence
  Primer
gggaattccatggagagtcaaccag

SEQ ID NO: 88 - DNA, 21 bp, Artificial sequence
  Primer
gcaagcttaacttgttaatag

SEQ ID NO: 89 - DNA, 22 bp, Artificial sequence
  Primer
gggaattccatggagaaaagcg

SEQ ID NO: 90 - DNA, 22 bp, Artificial sequence
  Primer
gcggatcctcactttttctttg

SEQ ID NO: 91 - DNA, 50 bp, Artificial sequence
  Primer
ggggtaccccgaaggaggaaaaaaaaatgtctacaaacgataatataaag

SEQ ID NO: 92 - DNA, 42 bp, Artificial sequence
  Primer
tgctctagagcattaattaatttctgcttctatagtttttat

---

What is claimed is:

1. A method of delivering a therapeutic agent to a solid tumor characterized by hypoxia, acidosis and hypertonicity comprising loading the therapeutic agent into sickle red blood cells and administering the therapeutic agent into the blood circulation of a patient wherein the sickle red blood cells accumulate in the tumor.

2. The method according to claim 1 wherein said administering step is further defined as administering intravenously the sickle red blood cells into the patient.

* * * * *